US009499592B2

(12) United States Patent
Zhang et al.

(10) Patent No.: US 9,499,592 B2
(45) Date of Patent: Nov. 22, 2016

(54) TRANSCRIPTION ACTIVATOR-LIKE EFFECTORS

(75) Inventors: Feng Zhang, Cambridge, MA (US); Le Cong, Brookline, MA (US); Sriram Kosuri, Cambridge, MA (US); George M. Church, Brookline, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 662 days.

(21) Appl. No.: 13/353,662

(22) Filed: Jan. 19, 2012

(65) Prior Publication Data

US 2012/0270273 A1 Oct. 25, 2012

Related U.S. Application Data

(60) Provisional application No. 61/436,396, filed on Jan. 26, 2011.

(51) Int. Cl.
*C07K 14/195* (2006.01)
*C07K 14/47* (2006.01)

(52) U.S. Cl.
CPC ......... *C07K 14/195* (2013.01); *C07K 14/4705* (2013.01); *C07K 2319/00* (2013.01); *C07K 2319/09* (2013.01); *C07K 2319/60* (2013.01); *C07K 2319/80* (2013.01)

(58) Field of Classification Search
None
See application file for complete search history.

(56) References Cited

PUBLICATIONS

Villalobos et al., Gene Designer: a synthetic biology tool for constructing artificial DNA segments; BMC Bioinformatics, vol. 7, No. 285, pp. 1-8, 2006.*

Beerli et al. (1998) PNAS 95:14628-14633. "Toward controlling gene expression at will: Specific regulation of the erbB-2/HER-2 promoter by using polydactyl zinc finger proteins constructed from modular building blocks."

Boch and Bonas (2010) Annu. Rev. Phytopathol. 48:419-436. "Xanthomonas AvrBs3 family-type III effectors: discovery and function."

Bogdanove et al. (2010) Curr. Opin. Plant Biol. 13:394-401. "TAL effectors: finding plant genes for disease and defense."

Engler et al. (2008) PLoS One 3, e3647. "A one pot, one step, precision cloning method with high throughput capability."

Engler et al. (2009) PLoS One 4, e5553. "Golden gate shuffling: a one-pot DNA shuffling method based on type IIs restriction enzymes."

Gu et al. (2005)Nature 435, 1122-1125. "R gene expression induced by a type-III effector triggers disease resistance in rice."

Herbers et al. (1992) Nature 356:172-174. "Race-specificity of plant resistance to bacterial spot disease determined by repetitive motifs in a bacterial avirulence protein."

Kay et al. (2007) Science 318:648-651. "A bacterial effector acts as a plant transcription factor and induces a cell size regulator."

Kosuri et al. (2010) Nat. Biotechnol. 28:1295-1299. "Scalable gene synthesis by selective amplification of DNA pools from high-fidelity microchips."

Marois et al. (2002)Mol. Plant-Microbe Interact. 15:637-646. "The Xanthomonas type III effector protein AvrBs3 modulates plant gene expression and induces cell hypertrophy in the susceptible host."

Murakami et al. (2010) Proteins 78:3386-3395. "The repeat domain of the type III effector protein PthA shows a TPR-like structure and undergoes conformational changes upon DNA interaction."

Romer et al. (2007) Science 318:645-648. "Plant pathogen recognition mediated by promoter activation of the pepper Bs3 resistance gene."

Schornack et al. (2006) J. Plant Physiol. 163:256. "Gene-for-gene-mediated recognition of nuclear-targeted AvrBs3-like bacterial effector proteins."

Zhang et al. (2011) Nat. Biotechnol. 9:2, 149-154. "Efficient construction of sequence-specific TAL effectors for modulating mammalian transcription."

* cited by examiner

*Primary Examiner* — Addison D Ault
(74) *Attorney, Agent, or Firm* — Banner & Witcoff, Ltd.

(57) ABSTRACT

Provided herein are compositions, kits and methods useful in the construction of designer transcription activator-like effector (dTALE) polypeptides.

12 Claims, 9 Drawing Sheets

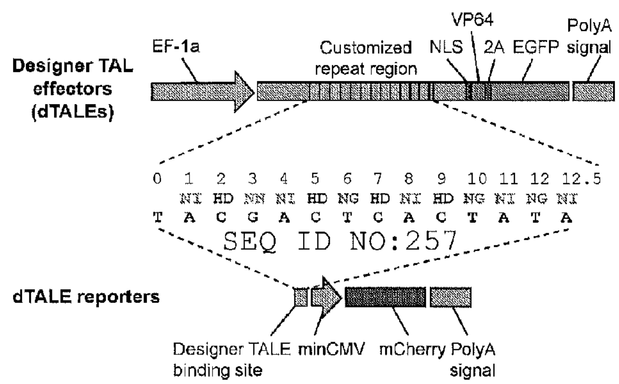
*FIG. 1C*
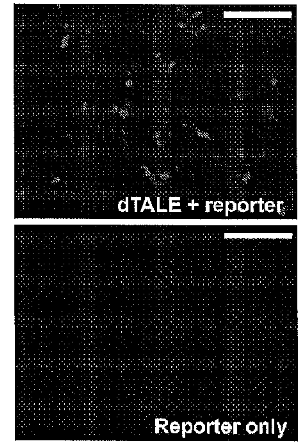
*FIG. 1D*
```
AA :                   G   L              G   L              G   L              G   L
DNA:   5'  .............GGA CTC........GGC CTC........GGA TTA........GGC TTA
       3'  .............CCT GAG........CCG GAG........CCT AAT........CCG AAT
           |---repeat 1---|---repeat 2---|---repeat 3---|---repeat 4---|---

AA :               G   L              G   L              G   L              G   L
DNA:   5'  .........GGA CTT........GGC CTT........GGA CTA........GGG CTC....
       3'  .........CCT GAA........CCG GAA........CCT GAT........CCC GAG....
           repeat 5---|---repeat 6---|---repeat 7---|---repeat 8---|---repe

AA :           G   L              G   L              G   L
DNA:   5'  ....GGG CTA........GGG TTA........GGT TTA............
       3'  ....CCC GAT........CCC AAT........CCA AAT............
           at 9---|---repeat10---|---repeat11---|---repeat12---|
```
*FIG. 2*

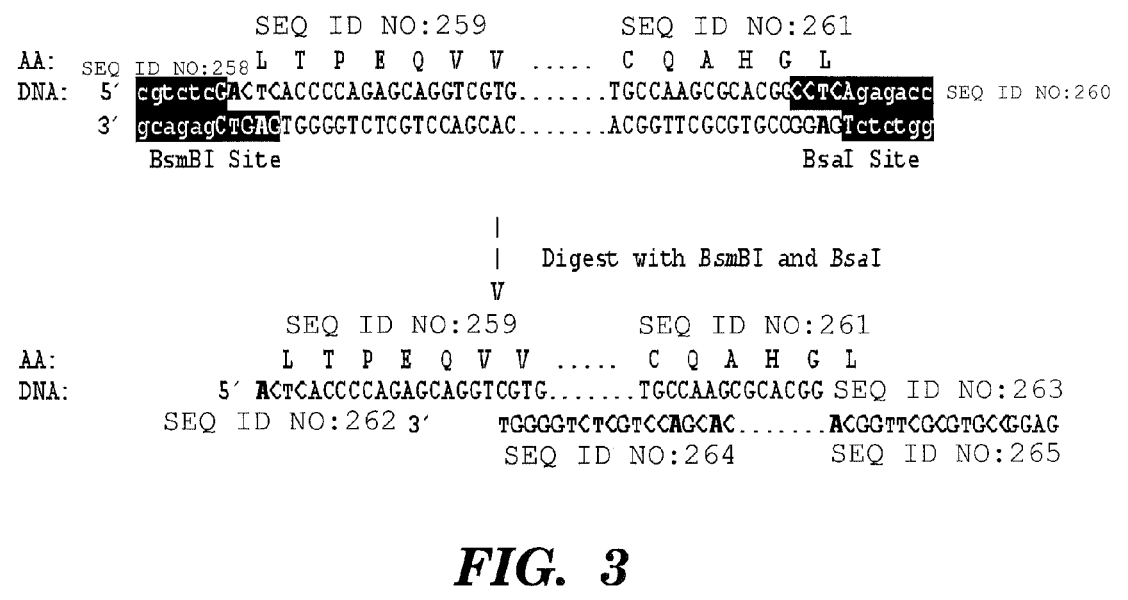

```
                SEQ ID NO:259          SEQ ID NO:261
AA:    SEQ ID NO:258 L  T  P  E  Q  V  V  .....  C  Q  A  H  G  L
DNA:  5′ cgtctcGACTCACCCCAGAGCAGGTCGTG.......TGCCAAGCGCACGGCCTCAgagacc SEQ ID NO:260
      3′ gcagagCTGAGTGGGGTCTCGTCCAGCAC.......ACGGTTCGCGTGCCGGAGTctctgg
         BsmBI Site                                      BsaI Site

                            |
                            |  Digest with BsmBI and BsaI
                            V
                   SEQ ID NO:259          SEQ ID NO:261
AA:                L  T  P  E  Q  V  V  .....  C  Q  A  H  G  L
DNA:            5′ ACTCACCCCAGAGCAGGTCGTG.......TGCCAAGCGCACGG SEQ ID NO:263
       SEQ ID NO:262 3′ TGGGGTCTCGTCCAGCAC.......ACGGTTCGCGTGCCGGAG
                        SEQ ID NO:264          SEQ ID NO:265
```

*FIG. 3*

Design of mCherry reporter plasmid. Target binding site of a dTALE was cloned into the mCherry reporter plasmid between the *Xba*I and *Bam*HI restriction site. Hence, the dTALE binding site is placed -96bp upstream of the transcription start site of a full-length mCherry gene, with a minimal CMV promoter in the middle.

```
 ▼N0                                                       ▼N1
1   MDPIRSRTPS PARELLSGPQ PDGVQPTADR GVSPPAGGPL DGLPARRTMS RTRLPSPPAP SPAFSADSFS

71  DLLRQFDPSL FNTSLFDSLP PFGAHHTEAA TGEWDEVQSG LRAADAPPPT MRVAVTAARP PRAKPAPRRR
     ▼N2              ▼N3                ▼N4                  ▼N5        ▼N6       ▼N7
141 AACPSDASPA AQVDLRTLGY SQQQQEKIKP KVRSTVAQHH EALVGHGFTH AHIVALSQHP AALGTVAVKY
                            ▼N8
211 QDMIAALPEA THEAIVGVGK QWSGARALEA LLTVAGELRG PPLQLDTGQL LKIAKRGGVT AVEAVHAWRN

281 ALTGAPLN    SEQ ID NO: 309

    ...34aa repeats...
         ▼C7         ▼C6               ▼C5              ▼C4              ▼C3
678 RPALESIVAQ LSRPDPALAA LTNDHLVALA CLGGRPALDA VKKGLPHAPA LIKRTNRRIP ERTSHRVADH
                                                                  ▼C2
748 AQVVRVLGFF QCHSHPAQAF DDAMTQFGMS RHGLLQLFRR VGVTELEARS GTLPPASQRW DRILQASGMK
                ▼C1                          ▼C0
798 RAKPSPTSTQ TPDQASLHAF ADSLERDLDA PSFMHEGDQT RASSRKRSRS DRAVTGPSAQ QSFEVRVPEQ

868 RDALHLPLLS WGVKRPRTRI GGLLDPGTPM DADLVASSTV VWEQDADPFA GTADDFPAFN EEELAWLMEL
                                  Wild type hax3 NLS and AD
938 LPQ     SEQ ID NO: 310
```

FIG. 6A

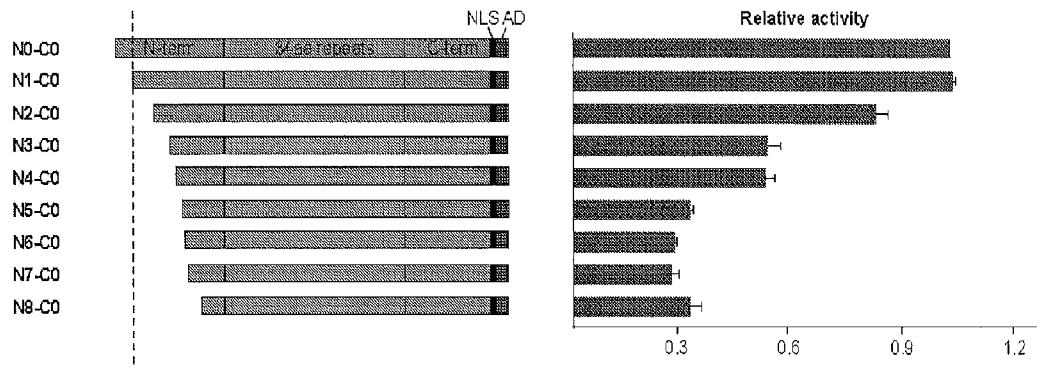

FIG. 6B

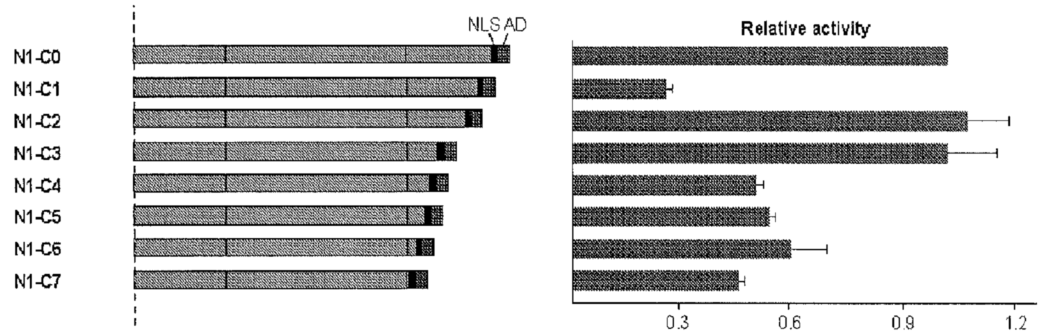

FIG. 6C

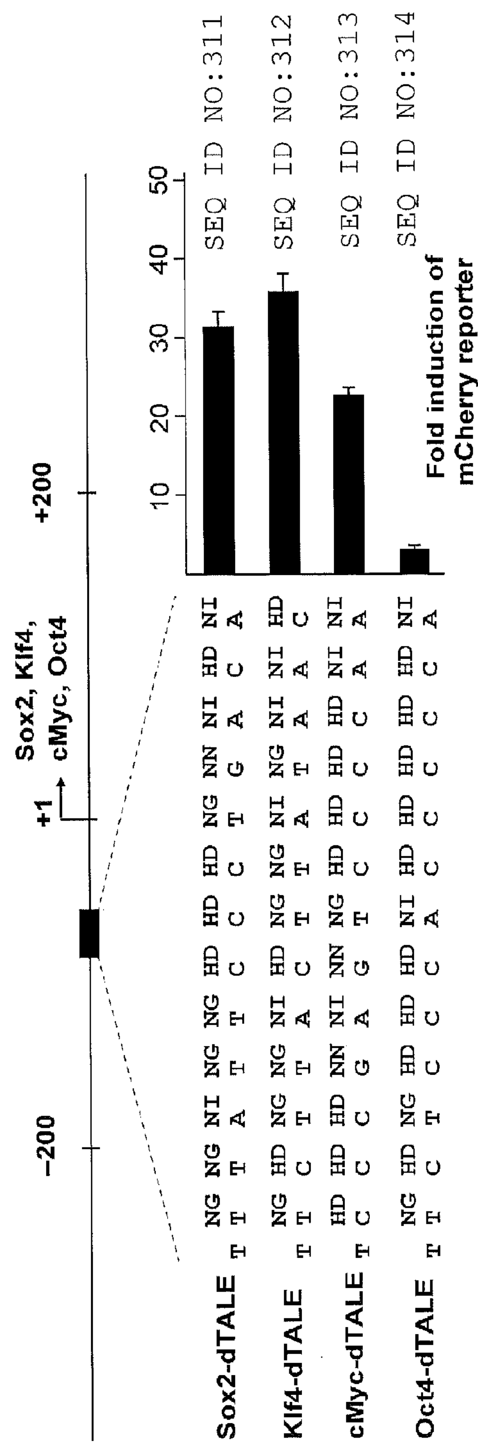
*FIG. 7A*
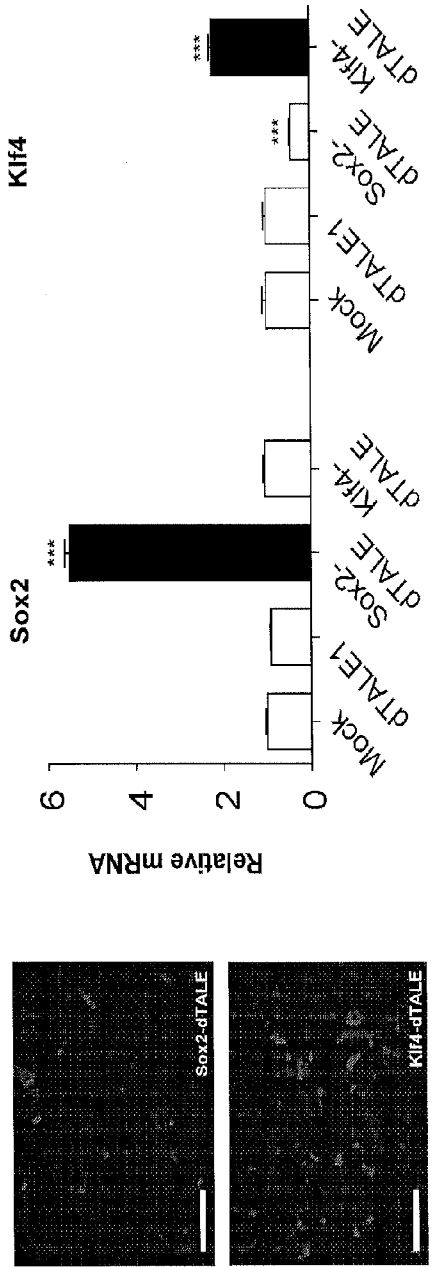
*FIG. 7B*
*FIG. 7C*

TRANSCRIPTION ACTIVATOR-LIKE EFFECTORS

CROSS-REFERENCE TO RELATED APPLICATIONS

This application claims benefit under 35 U.S.C. §119(e) of U.S. Provisional Patent Application Ser. No. 61/436,396 filed on 26 Jan. 2011, the contents of which are incorporated herein by reference in their entirety.

GOVERNMENT SUPPORT

This invention was made with Government Support under NS073124, HG003170, and HG005550 awarded by the National Institutes of Health, under EEC-0540879 awarded by the National Science Foundation, under W911NF-08-1-0254 awarded by U.S. Department of Defense/DARPA, and under DE-FG02-02ER63445 awarded by the U.S. Department of Energy. The Government has certain rights in the invention.

SEQUENCE LISTING

The instant application contains a Sequence Listing which has been submitted in ASCII format via EFS-Web and is hereby incorporated by reference in its entirety. Said ASCII copy, created on Mar. 30, 2012, is named 28672761.txt and is 1,528,805 bytes in size.

FIELD OF THE INVENTION

This invention relates to polypeptide sequences that act as sequence-specific nucleic acid binding proteins, methods of their use, and methods and kits thereof for constructing such polypeptide sequences.

BACKGROUND

Systematic interrogation and engineering of biological systems in normal and pathological states depend on the ability to manipulate the genome of target cells with efficiency and precision. Achieving the needed efficiency and precision, however, is difficult, expensive, and often not possible with existing technologies.

SUMMARY OF THE INVENTION

Provided herein are compositions and kits comprising customized polypeptide sequences that act as sequence-specific nucleic acid binding proteins, termed herein as "designer transcription activator-like effectors" or "dTALE polypeptides," as well as nucleic acid sequences and expression vectors encoding these dTALE polypeptides, and methods of their use in, for example, modulating gene expression and targeted genome engineering applications. The compositions and methods provided herein are useful in constructing sequence-specific nucleic acid binding proteins that can target protein effector domains. As demonstrated herein, endogenous genes, such as genes encoding pluripotency transcription factors, can be activated using dTALE polypeptides generated using the methods and expression vectors described herein.

In addition, expression vectors, methods, and kits are provided herein that are useful for constructing nucleic acid molecules that encode, and polypeptides having, self-assembled polypeptide sequences ordered in a predetermined 5' to 3' direction using a hierarchical ligation strategy. Such expression vectors, kits and methods are useful in engineering a predetermined order of polypeptide sequences in a 5' to 3' direction, particularly when the polypeptide sequences are repetitive in nature, such as when generating the dTALE polypeptide compositions described further herein.

Accordingly, provided herein, in some aspects are compositions comprising nucleic acid molecules encoding a designer transcription activator-like effector (dTALE) polypeptide. Such nucleic acid molecules comprise a sequence encoding a nucleic acid binding domain and one or more mammalian effector domains, such that the sequence encoding the nucleic acid binding domain comprises sequences encoding two or more monomer units arranged in a predetermined 5' to 3' order. Each monomer unit encoded by the nucleic acid molecule comprises a variable disresidue that specifically binds a target nucleotide, such that the nucleic acid binding domain encoded by the nucleic acid molecule specifically binds a predetermined nucleic acid sequence. Further, each one or more mammalian effector domains encoded by the nucleic acid molecule mediates an effector function.

In some embodiments of the aspects and all such aspects described herein, the sequence encoding the two or more monomer units is selected from the group consisting of: a) a sequence encoding the monomer units of a TALE polypeptide of SEQ ID NOs: 4-167; the nucleic acid sequences of SEQ ID NOs: 168-171 and SEQ ID NOs: 197, 199, 201, and 203; or a sequence encoding the monomer units of SEQ ID NOs: 171-191; b) a sequence encoding an amino acid sequence that is at least 70% identical to: the repeat sequence of a TALE polypeptide of SEQ ID NOs: 4-167; the nucleic acid sequences of SEQ ID NOs: 168-171 and SEQ ID NOs: 197, 199, 201, and 203; or a sequence encoding the monomer units of SEQ ID NOs: 171-191; and c) a fragment of the peptide encoded by a) or b) that is capable of specifically binding a nucleotide.

In some embodiments of the aspects and all such aspects described herein, the predetermined nucleic acid sequence to which the nucleic acid binding domain specifically binds comprises bacterial, protozoan, fungal, animal, or viral nucleic acid sequence.

In some embodiments of the aspects and all such aspects described herein, the nucleic acid molecule further comprises at least one nucleic acid sequence: a) of an expression vector; b) of a nuclear localization signal; c) encoding an N-terminal domain that is at least 70% identical to the amino acid sequence of an N-terminal domain sequence from a transcription activator-like effector (TALE) polypeptide from a bacterium of the genus *Xanthomonas*, or a fragment thereof, and where the sequence encoding the N-terminal domain is 5' of the sequence encoding the nucleic acid binding domain of the dTALE polypeptide; d) encoding a C-terminal domain that is at least 70% identical to the amino acid sequence of a C-terminal domain from a transcription activator-like effector (TALE) polypeptide from a bacterium of the genus *Xanthomonas*, or a fragment thereof, and where the sequence encoding the C-terminal domain is 3' of the sequence encoding the nucleic acid binding domain of the dTALE polypeptide; or e) any combination thereof.

In some such embodiments, the nucleic acid molecule comprises: a sequence encoding an N-terminal domain that is at least 70% identical to the amino acid sequence of an N-terminal domain sequence from a transcription activator-like effector (TALE) polypeptide from a bacterium of the genus *Xanthomonas*, or a fragment thereof, such that the sequence encoding the N-terminal domain is 5' of the sequence encoding the nucleic acid binding domain of the dTALE polypeptide; a sequence encoding a C-terminal domain that is at least 70% identical to the amino acid sequence of a C-terminal domain from a transcription activator-like effector (TALE) polypeptide from a bacterium of the genus *Xanthomonas*, or a fragment thereof, such that the sequence encoding the C-terminal domain is 3' of the sequence encoding the nucleic acid binding domain of the dTALE polypeptide; or a combination thereof, and the TALE polypeptide from a bacterium of the genus *Xanthomonas* comprises a sequence selected from SEQ ID NOs: 4-167.

In some embodiments of the aspects and all such aspects described herein, the divariable residues of at least one of the monomer units encoded by the nucleic acid molecule are engineered to specifically bind a predetermined nucleotide.

In some embodiments of the aspects and all such aspects described herein, the nucleic acid sequence encoding each at least two monomer units is engineered to minimize sequence repetitiveness among the monomer units encoded by the nucleic acid molecule.

In some embodiments of the aspects and all such aspects described herein, the monomer unit encoded at the 5' end of the nucleic acid molecule specifically binds to a thymine nucleotide. In some such embodiments, the divariable residues of at least one of the at least two monomer units encoded by the nucleic acid molecule are engineered to specifically bind a predetermined nucleic acid sequence by encoding NG for specifically binding thymine, HD for specifically binding cytosine, NI for specifically binding adenine, or NN for specifically binding guanine.

In some embodiments of the aspects and all such aspects described herein, each sequence encoding the at least two monomer units is contiguous and does not comprise insertion or deletion of nucleic acid sequences.

In some embodiments of the aspects and all such aspects described herein, the effector function mediated by the one or more mammalian effector domains is a nuclease function, recombinase function, epigenetic modifying function, transposase function, integrase function, resolvase function, invertase function, protease function, DNA methyltransferase function, DNA demethylase function, histone acetylase function, histone deacetylase function, transcriptional repressor function, transcriptional activator function, DNA binding protein function, transcription factor recruiting protein function, nuclear-localization signal function, cellular uptake signal activity function, or any combination thereof.

In some embodiments of the aspects and all such aspects described herein, where the nucleic acid molecule further comprises the sequence of an expression vector, one or more effector domains, nuclear localization signal, or combination thereof, the expression vector, one or more effector domains, nuclear localization signal, or combination thereof has activity in a host cell that is not a plant cell.

In some such embodiments, the host cell is a bacterial, protozoan, fungal, or animal cell. In some such embodiments, the animal cell is a mammalian cell or a human cell.

In some embodiments of the aspects and all such aspects described herein, the nucleic acid molecule further comprises an expression vector comprising a sequence of an expression vector of SEQ ID NOs: 192-195, and the at least one sequence encoding a monomer unit of the nucleic acid molecule is selected from: a nucleic acid sequence encoding the repeat sequence of a TALE polypeptide of SEQ ID NOs: 4-167; the nucleic acid sequences of SEQ ID NOs: 168-171 and SEQ ID NOs: 197, 199, 201, and 203; or nucleic acid sequences encoding the monomer units of SEQ ID NOs: 171-191.

Also provided herein, in some aspects are compositions comprising dTALE polypeptides encoded by nucleic acid molecules comprising a sequence encoding a nucleic acid binding domain and one or more mammalian effector domains, such that the sequence encoding the nucleic acid binding domain comprises sequences encoding two or more monomer units arranged in a predetermined 5' to 3' order. Each monomer unit of the dTALE polypeptide encoded by the nucleic acid molecule comprises a variable disresidue that specifically binds a target nucleotide, such that the nucleic acid binding domain encoded by the nucleic acid molecule specifically binds a predetermined nucleic acid sequence. Further, each one or more mammalian effector domains encoded by the nucleic acid molecule mediates an effector function.

In some aspects, provided herein are cells comprising a nucleic acid molecule, where the nucleic acid molecule comprises a sequence encoding a nucleic acid binding domain and one or more mammalian effector domains, such that the sequence encoding the nucleic acid binding domain comprises sequences encoding two or more monomer units arranged in a predetermined 5' to 3' order. Each monomer unit of the dTALE polypeptide encoded by the nucleic acid molecule comprises a variable disresidue that specifically binds a target nucleotide, such that the nucleic acid binding domain encoded by the nucleic acid molecule specifically binds a predetermined nucleic acid sequence. Further, each one or more mammalian effector domains encoded by the nucleic acid molecule mediates an effector function.

In some aspects, described herein are cells comprising a dTALE polypeptide encoded by a nucleic acid molecule, such that the nucleic acid molecule comprises a sequence encoding a nucleic acid binding domain and one or more mammalian effector domains, such that the sequence encoding the nucleic acid binding domain comprises sequences encoding two or more monomer units arranged in a predetermined 5' to 3' order. Each monomer unit of the dTALE polypeptide encoded by the nucleic acid molecule comprises a variable disresidue that specifically binds a target nucleotide, such that the nucleic acid binding domain encoded by the nucleic acid molecule specifically binds a predetermined nucleic acid sequence. Further, each one or more mammalian effector domains.

Also provided herein, in some aspects, are methods of constructing a nucleic acid molecule encoding self-assembled peptide sequences ordered in a predetermined 5' to 3' direction. Such methods comprise:

a) generating a plurality of nucleic acid molecules, such that each of the plurality of nucleic acid molecules: encodes a peptide sequence, comprises a 5' ligatable junction end sequence comprising a Type II restriction enzyme recognition sequence, and comprises a 3' ligatable junction end sequence comprising a Type II restriction enzyme recognition sequence, and where the sequences of the plurality of nucleic acid molecules generated are selected such that:

1) each 5' ligatable junction end sequence generates a 5' sticky end overhang sequence upon digestion with one or more Type Hs restriction enzymes, such that the 5' sticky end overhang sequence can be ligated to a 3' ligatable junction end sequence of a nucleic acid molecule having an orthogonal sticky end sequence;

2) each 3' ligatable junction end sequence generates a 3' sticky end overhang sequence upon digestion with one or more Type IIs restriction enzymes, such that the 3' sticky end overhang sequence can be ligated to a 5' ligatable junction end sequence of a nucleic acid molecule having an orthogonal sticky end sequence;

3) the plurality of nucleic acid molecules do not comprise any additional recognition sites for one or more Type IIs restriction enzymes; and 4) upon digestion by one or more Type IIs restriction enzymes, the 5' ligatable junction end sequence of each nucleic acid molecule of the plurality of nucleic acid molecules is designed to be orthogonal to a 3' ligatable junction end sequence of another nucleic acid molecule of the plurality of nucleic acid molecules according to the predetermined 5' to 3' order of encoded polypeptide sequences, except for the most 5' polypeptide sequence;

b) digesting the plurality of nucleic acid molecules with one or more Type II restriction enzymes to generate sticky end overhang sequences at the 5' ligatable junction end sequences and 3' ligation junction end sequences of each of the plurality of nucleic acid molecules;

c) ligating the plurality of digested nucleic acid molecules, thereby producing one or more ligation products; and d) isolating the nucleic acid molecule encoding the self-assembled peptide sequences ordered in a predetermined 5' to 3' direction from the ligation products of step c).

In some embodiments of these methods and all such methods described herein, the self-assembled peptide sequences ordered in a predetermined 5' to 3' direction comprise monomer units that specifically bind to a nucleotide selected from the group consisting of: a) a repeat sequence of a TALE polypeptide of SEQ ID NOs: 4-167; the monomer units encoded by the nucleic acid sequences of SEQ ID NOs: 168-171 and SEQ ID NOs: 197, 199, 201, and 203; or the monomer units of SEQ ID NOs: 171-191; b) an amino acid sequence that is at least 70% identical to: the repeat sequence of a TALE polypeptide of SEQ ID NOs: 4-167; the monomer units encoded by the nucleic acid sequences of SEQ ID NOs: 168-171 and SEQ ID NOs: 197, 199, 201, and 203; or the monomer units of SEQ ID NOs: 171-191; and c) a fragment of a) or b) that is capable of specifically binding a nucleotide.

In some embodiments of these methods and all such methods described herein, the sequence encoding the one or more monomer units ordered in a predetermined 5' to 3' direction is engineered to bind specifically to a predetermined nucleic acid sequence.

In some embodiments of these methods and all such methods described herein, the sequence encoding amino acids 12 and 13 of at least one of the monomer units is engineered to bind specifically to a predetermined nucleotide.

In some embodiments of these methods and all such methods described herein, the sequence encoding each monomer unit is engineered to minimize sequence repetitiveness among the monomer units encoded by the nucleic acid molecule.

In some embodiments of these methods and all such methods described herein, the 5' most monomer unit of the isolated nucleic acid molecule specifically binds to a thymine nucleotide.

In some embodiments of these methods and all such methods described herein, the sequence encoding amino acids 12-13 of at least some of the monomer units are engineered to specifically bind the predetermined nucleic acid sequence by encoding NG for thymine, HD for cytosine, NI for adenine, and NN for guanine.

In some embodiments of these methods and all such methods described herein, the 5' and 3' ligatable junction end sequences of each nucleic acid molecule encoding a polypeptide sequence to be ordered in a predetermined 5' to 3' direction is generated using polymerase chain reaction and linker primers.

In some embodiments of these methods and all such methods described herein, each ligated orthogonal 5' to 3' junction end sequence preserves the contiguous coding sequence of each encoded polypeptide sequence to be ordered in a predetermined 5' to 3' direction without insertion or deletion of nucleic acid sequence information.

In some embodiments of these methods and all such methods described herein, the orthogonal sequence recognition of encoded self-assembled polypeptide sequences ordered in a predetermined 5' to 3' direction is determined by engineering codon pairs between the 5' ligatable junction and 3' ligation junction ends of nucleic acid molecules to be ligated in order according to the predetermined 5' to 3' direction.

In some embodiments of these methods and all such methods described herein, the Type IIs restriction enzymes used for digesting the plurality of nucleic acid molecules of step b) are selected from BsmBI, BsaI, BtsCI, BsrDI, BtsI, AlwI, BccI, BsmAI, EarI, PleI, BmrI, BspQI, FauI, HpyAV, MnlI, SapI, BbsI, BciVI, HphI, MboII, BfuAI, BspCNI, BspMI, SfaNI, HgaI, BseRI, BbvI, EciI, FokI, AcuI, BceAI, BsmFI, BtgZI, BpuEI, BpmI, BsgI, MmeI, NmeAIII, or any combination thereof.

In some embodiments of these methods and all such methods described herein, the ligating step c) is catalyzed by T7 DNA ligase In some embodiments of these methods and all such methods described herein, all the digesting and/or ligating steps occurs in the same reaction simultaneously.

In other embodiments of these methods and all such methods described herein, the digesting and/or ligating steps occur in two or more different reactions according to a target number of self-assembled polypeptide sequences ordered in a predetermined 5' to 3' direction to be ligated. In some such embodiments, the ligation products of step c) are amplified prior to the isolating step, and the steps of digesting and ligating are subsequently repeated to generate amplified nucleic acid molecules encoding self-assembled polypeptide sequences ordered in a predetermined 5' to 3' direction.

In some embodiments of these methods and all such methods described herein, the step of isolating the desired nucleic acid molecule encoding self-assembled polypeptide sequences ordered in a predetermined 5' to 3' direction from the ligation products is performed using size fractionation of nucleic acid molecules. In some such embodiments, the desired nucleic acid molecule encoding self-assembled polypeptide sequences ordered in a predetermined 5' to 3' direction is amplified prior to size fractionation.

In some embodiments of these methods and all such methods described herein, the method further comprises cloning the nucleic acid molecule encoding self-assembled polypeptide sequences ordered in a predetermined 5' to 3' direction into a vector sequence. In some such embodiments, the vector is an expression vector capable of expression in a host cell. In some such embodiments, host cell is selected from the group consisting of a bacterial, protozoan, fungal, or animal cell. In some such embodiments, the animal cell is a mammalian cell or a human cell.

In some such embodiments, the vector sequence further comprises a sequence encoding an effector domain. In some such embodiments, the effector domain has nuclease, recombinase, epigenetic modifying, transposase, integrase, resolvase, invertase, protease, DNA methyltransferase, DNA demethylase, histone acetylase, histone deacetylase, transcriptional repressor, transcriptional activator, DNA binding protein, transcription factor recruiting protein, nuclear-localization signal, and/or cellular uptake signal activity, or any combination thereof.

In those embodiments of these methods where the method further comprises cloning nucleic acid molecule encoding self-assembled polypeptide sequences ordered in a predetermined 5' to 3' direction into a vector sequence, the vector sequence can, in some embodiments, comprise a sequence of a vector of SEQ ID NOs: 192-195.

In some embodiments of these methods and all such methods described herein, the method further comprises the step of expressing the nucleic acid molecule in a host cell in order to produce the encoded self-assembled polypeptide sequence ordered in a predetermined 5' to 3' direction of step d).

In some aspects, also provided herein are polypeptides produced according to any of the methods described herein.

In some aspects, also provided herein are nucleic acid molecules encoding self-assembled polypeptide sequences ordered in a predetermined 5' to 3' direction produced according to any of the methods described herein.

In some aspects, provided herein are cells comprising nucleic acid molecules encoding self-assembled polypeptide sequences ordered in a predetermined 5' to 3' direction produced according to any of the methods described herein.

In some aspects, provided herein are cells comprising polypeptides encoded by nucleic acid molecules encoding self-assembled polypeptide sequences ordered in a predetermined 5' to 3' direction produced according to any of the methods described herein.

Also provided herein, in some aspects, are a plurality of nucleic acid molecules, each of which: encodes a peptide sequence, comprises a 5' ligatable junction end sequence, and comprises a 3' ligatable junction end sequence, such that the sequences of the plurality of nucleic acid molecules are selected such that:

1) each 5' ligatable junction end sequence generates a 5' sticky end overhang sequence upon digestion with one or more Type IIs restriction enzymes, such that the 5' sticky end overhang sequence can be ligated to a digested 3' ligatable junction end sequence of a nucleic acid molecule having an orthogonal sticky end sequence; and 2) each 3' ligatable junction end sequence generates a 3' sticky end overhang sequence upon digestion with one or more Type IIs restriction enzymes, such that the 3' sticky end overhang sequence can ligated to a digested 5' ligatable junction end sequence of a nucleic acid molecule having an orthogonal sticky end sequence;

3) each of the plurality of nucleic acid molecules do not comprise any additional recognition sites for one or more Type IIs restriction enzymes;

4) the 5' ligatable junction end sequence of each nucleic acid molecule of the plurality of nucleic acid molecules is designed to be orthogonal to a 3' ligatable junction end sequence of another nucleic acid molecule of the plurality of nucleic acid molecules upon digestion with the one or more Type IIs restriction enzymes according to the predetermined 5' to 3' order of encoded polypeptide sequences, except for the most 5' polypeptide sequence.

In some embodiments of theses aspects and all such aspects described herein, the peptide sequence is a monomer unit sequence selected from the group consisting of: a) a repeat sequence of a TALE polypeptide of SEQ ID NOs: 4-167; the monomer units encoded by the nucleic acid sequences of SEQ ID NOs: 168-171 and SEQ ID NOs: 197, 199, 201, and 203; or the monomer units of SEQ ID NOs: 171-191; b) an amino acid sequence that is at least 70% identical to: the repeat sequence of a TALE polypeptide of SEQ ID NOs: 4-167; the monomer units encoded by the nucleic acid sequences of SEQ ID NOs: 168-171 and SEQ ID NOs: 197, 199, 201, and 203; or the monomer units of SEQ ID NOs: 171-191; and c) a fragment of a) or b) that is capable of specifically binding a nucleotide.

Provided herein, in some aspects, are kits comprising a library of nucleic acid sequences encoding one or more monomer units, where the monomer units have sequences selected from the group consisting of: a) a repeat sequence of a TALE polypeptide of SEQ ID NOs: 4-167; the monomer units encoded by the nucleic acid sequences of SEQ ID NOs: 168-171 and SEQ ID NOs: 197, 199, 201, and 203; or the monomer units of SEQ ID NOs: 171-191; b) an amino acid sequence that is at least 70% identical to: the repeat sequence of a TALE polypeptide of SEQ ID NOs: 4-167; the monomer units encoded by the nucleic acid sequences of SEQ ID NOs: 168-171 and SEQ ID NOs: 197, 199, 201, and 203; or the monomer units of SEQ ID NOs: 171-191; and c) a fragment of a) or b) that is capable of specifically binding a nucleotide.

In some embodiments of these kits, the kits further comprise a vector comprising a sequence of SEQ ID NOs: 192-195.

As used herein the term "comprising" or "comprises" is used in reference to compositions, methods, and respective component(s) thereof, that are essential to the invention, yet open to the inclusion of unspecified elements, whether essential or not.

As used herein the term "consisting essentially of" refers to those elements required for a given embodiment. The term permits the presence of elements that do not materially affect the basic and novel or functional characteristic(s) of that embodiment of the invention.

The term "consisting of" refers to compositions, methods, and respective components thereof as described herein, which are exclusive of any element not recited in that description of the embodiment.

As used in this specification and the appended claims, the singular forms "a," "an," and "the" include plural references unless the context clearly dictates otherwise. Thus for example, references to "the method" includes one or more methods, and/or steps of the type described herein and/or which will become apparent to those persons skilled in the art upon reading this disclosure and so forth.

The practice of the methods described herein will employ, unless otherwise indicated, conventional techniques of molecular biology, microbiology and recombinant DNA techniques, which are within the skill of the art. Such techniques are explained fully in the literature. See, e.g., Sambrook, Fritsch & Maniatis, 1989, Molecular Cloning: A Laboratory Manual, Second Edition; Oligonucleotide Synthesis (M. J. Gait, ed., 1984); Polynucleotide Hybridization (B. D. Harnes & S. J. Higgins, eds., 1984); A Practical Guide to Molecular Cloning (B. Perbal, 1984); and a series, Methods in Enzymology (Academic Press, Inc.); Short Protocols In Molecular Biology, (Ausubel et al., ed., 1995).

It is understood that the following detailed description and the following examples are illustrative only and are not to be taken as limitations upon the scope of the invention. Various changes and modifications to the disclosed embodiments, which will be apparent to those of skill in the art, may be made without departing from the spirit and scope of the present invention. Further, all patents, patent applications, and publications identified in the specification and examples are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents are based on the information available to the applicants and do not constitute any admission as to the correctness of the dates or contents of these documents.

BRIEF DESCRIPTION OF THE DRAWINGS

FIGS. 1A-1D shows a schematic representation of a design and construction of dTALEs for use in mammalian cells. FIG. 1A depicts a schematic representation of native endogenous TALE hax3 from *Xanthomonas campestris* pv. *armoraciae* (SEQ ID NO: 256) depicting the nucleic acid binding domain comprising tandem monomer units and two repeat variable di-residues within each monomer unit. These di-residues determine the base recognition specificity. Four naturally occurring di-residues used for the construction of customized artificial designer TALE polypeptides described herein are listed together with their major base specificity. NLS, nuclear localization signal; AD, activation domain of the native TAL effector. FIG. 1B depicts a schematic of an embodiment of the hierarchical ligation assembly method described herein for the construction of customized dTALE polypeptides. Twelve separate PCRs are done for each of the four types of nucleic acid sequence encoding monomer units (NI, HD, NG and NN) to generate a set of 48 monomer units to serve as assembly starting material. Each of the 12 PCR products for a given monomer unit type (e.g., NI) has a unique linker specifying its programmed position in the assembly. After enzymatic digestion with a type IIs restriction endonuclease (e.g., BsaI), orthogonal overhangs are made by recoding each amino acid in the junction to use an alternative codon. The unique overhangs facilitate the positioning of each monomer unit in the ligation product. The ligation product was PCR amplified subsequently to yield full-length tandem repeats of monomer units, i.e., a nucleic acid binding region, which were then cloned into a backbone plasmid comprising nucleic acid sequences encoding the N and C termini of the wild-type TALE hax3. FIG. 1C depicts a Schematic representation of an embodiment of a fluorescence reporter system for testing recognition by a dTALE polypeptide of a target nucleic acid sequence. The diagram illustrates the composition of the nucleic acid binding domain (SEQ ID NO: 257) comprising tandem monomer units of a dTALE polypeptide and its corresponding 14-bp target DNA sequence in the fluorescent reporter plasmid. VP64, synthetic transcription activation domain; 2A, self-cleavage peptide. FIG. 10 shows that a 293FT cells co-transfected with a plasmid encoding a dTALE polypeptide and its corresponding reporter plasmid showed considerably greater mCherry expression compared with the reporter-only control, thus demonstrating that the dTALE polypeptide binds the target DNA sequence on the reporter plasmid and drives mCherry expression. Scale bars, 200 μm.

FIG. 2 shows representative nucleic acid sequences (and corresponding amino acids) for the junction regions of an exemplary dTALE nucleic acid binding domain comprising 12 monomer units.

FIG. 3 shows a representative nucleic acid sequence encoding a monomer unit (and amino acid sequence) before and after enzymatic digestion of the 5'- and 3'-junction ends of the monomer unit. FIG. 3 discloses SEQ ID NOS 259, 261, 258, 260, 259, 261, and 262-265, respectively, in order of appearance.

FIG. 4 discloses SEQ ID NO: 266.

FIG. 5A discloses SEQ ID NOS 257 and 267-279, respectively, in order of appearance. FIG. 5B discloses SEQ ID NOS 278 and 280-294, respectively, in order of appearance. FIG. 5C discloses SEQ ID NOS 257, 268, 267, 295, 270, 273, 296-299, and 269-271, respectively, in order of appearance. FIG. 5D discloses SEQ ID NOS 257 and 300-308, respectively, in order of appearance.

FIGS. 6A-6C show results of reporter expression using N- and C-terminal truncation constructs of dTALE1 polypeptide in mammalian cells. FIG. 6A depicts the N- and C-terminal amino acid sequence of wild-type endogenous TALE hax3 (SEQ ID NOS 309 and 310, respectively, in order of appearance) showing positions of all N- and C-terminal truncation constructs tested herein in 293FT cells. N0 to N8 designates N-terminal truncation positions (N0 retains the full-length N terminus), and C0 to C7 designate C-terminal truncations. Amino acids representing the nuclear localization signal and the activation domain in the native hax3 protein are underlined. FIG. 6B shows relative activity of each N-terminal TALE polypeptide truncation construct compared to a dTALE polypeptide having no truncation at either termini (N0-C0). TALE truncation positions are indicated in FIG. 5B. Error bars indicate s.e.m.; n=3. TALE-TALE relative activity was calculated by dividing the fold induction of the construct by the fold induction of the reporter gene. Fold induction calculated as in a. FIG. 6C shows relative activity of each C-terminal truncation dTALE polypeptid compared to a dTALE polypeptide having no truncation at either termini (N1,C0).

FIGS. 7A-7C demonstrates activation of endogenous pluripotency transcription factors in the genome by dTALE polypeptides in mammalian cells. FIG. 7A depicts variable diresidues of dTALE polypeptides designed to target different nucleic acid sequences in the promoters of the genes encoding the transcription factors SOX2, KLF4, c-MYC and OCT4 (SEQ ID NOS 311-314, respectively) are demonstrated to facilitate activation of mCherry reporter in 293FT cells. The target nucleic acid sequences are selected from the 200-bp proximal promoter region of each gene. Fold induction was determined by flow cytometry analysis using the same methodology as in FIGS. 5A-5D. FIG. 7B shows images of dTALE polypeptide-induced mCherry reporter expression in 293FT cells. Scale bar, 200 μm. FIG. 7C shows levels of SOX2 and KLF4 mRNA in transfected 293FT cells, as determined by quantitative RT-PCR. Mock-treated cells received the transfection vehicle. TALE1, which does not target any of the target nucleic acid sequences of the pluripotency transcription factors was used as a negative control. Error bars indicate s.e.m.; n=3. *** indicates P<0.005.

DETAILED DESCRIPTION

Figure 1A:
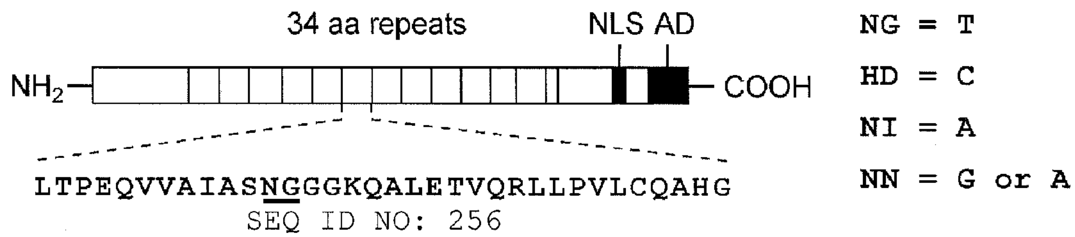

Provided herein are compositions and kits comprising customized polypeptide sequences that act as sequence-specific nucleic acid binding proteins, termed herein as "designer transcription activator-like effectors" or "dTALE polypeptides," nucleic acid sequences and expression vectors encoding these dTALE polypeptides, and methods of their use in, for example, modulating gene expression and targeted genome engineering applications. As demonstrated herein, dTALE polypeptides generated according to the methods described herein can activate endogenous genes for transcription factors, and can hence, in some embodiments, be useful in cellular reprogramming and cellular differentiation. Also provided herein are novel expression vectors methods and kits thereof for constructing such dTALEs. The compositions and methods provided herein are useful in constructing sequence-specific nucleic acid binding proteins that can target protein effector domains.

As described herein, the inventors have discovered that nucleic acid molecules encoding polypeptides having activity of designer transcription activator-like effectors (dTALEs) are useful in, for example, the targeted delivery of polypeptide effector domains to the location of a predetermined nucleic acid sequence. Such compositions encode (or the resulting polypeptide) comprise: a nucleic acid binding domain having monomer units arranged in a predetermined 5' to 3' order, each monomer unit having an affinity to bind a nucleotide, such that the nucleic acid binding domain of a dTALE polypeptide specifically binds a corresponding predetermined nucleic acid sequence, termed herein the "target nucleic acid sequence." The engineered 5' to 3' order of the monomer units, each monomer unit of which has an affinity to bind a predetermined nucleotide, provides the skilled artisan with a targeted technique for binding to a predetermined nucleic acid sequence, as opposed to time-consuming and inefficient screening methods (e.g., screening of random ligation-mediated libraries) known in the art to select nucleic acid binding proteins. In some embodiments, the compositions further encode or have a mammalian effector domain. The dTALE compositions described herein have effector activity in non-plant cells (e.g., mammalian and human cells) in a nucleic acid sequence-targeted manner, whereas natural or endogenous TALEs are bacterial proteins that are active in plant cells.

In addition, expression vectors, kits and methods are provided herein that are useful for constructing nucleic acid molecules that encode, and polypeptides having, self-assembled polypeptide sequences ordered in a predetermined 5' to 3' direction using a hierarchical ligation strategy. Such expression vectors, kits and methods are useful in engineering a predetermined order of polypeptide sequences in a 5' to 3' direction, particularly when the polypeptide sequences are repetitive in nature and/or when generating the dTALE polypeptide compositions described further herein. For example, repetitive nucleic acid sequences are currently difficult to manipulate for myriad reasons, including, but not limited to, susceptibility to recombination and difficulty of specific PCR amplification.

designer Transcription Activator-Like Effectors (dTALEs)

Provided herein are compositions and kits comprising customized polypeptide sequences that act as sequence-specific nucleic acid binding proteins, termed herein as "designer transcription activator-like effectors" or "dTALEs," and nucleic acid molecules and expression vectors encoding such dTALEs, and methods of their use in, for example, modulating gene expression and targeted genome engineering applications. Also provided herein are novel methods, expression vectors, and kits thereof for constructing such dTALEs.

As opposed to designer TALEs, the terms "natural TALEs" or "endogenous TALEs," as used herein, refer to effector proteins secreted by numerous species and genus of bacteria (e.g., *Xanthomonas* and *Ralstonia*) to affect host gene expression and facilitate bacterial colonization and survival (Boch and Bonas (2010) *Annu. Rev. Phytopathol.* 48:419-436; Bogdanove et al. (2010) *Curr. Opin. Plant Biol.* 13:394-401; Kay et al. (2007) *Science* 318:648-651; Schornack et al. (2006) *J. Plant Physiol.* 163:256; Romer et al. (2007) *Science* 318:645-648; and Beerli et al. (1998) *PNAS* 95:14628-14633; each of which is incorporated by reference herein in its entirety by reference).

Endogenous TALEs generally comprise a highly conserved repetitive central domain within the middle of the protein, consisting of contiguous or tandem repeats (also referred to herein as monomer units) that are generally each 33, 34, or 35 amino acids in length, a nuclear localization signals (NLSs), and an activation domain (AD), and have been shown to act as transcription factors in plant cells (Kay et al. (2007) Science 318:648-651; Romer et al. (2007) Science 318:645-648; Gu et al. (2005) Nature 435, 1122-1125). The prototypical member of this effector family, AvrBs3 from *Xanthomonas campestris* pv. *vesicatoria*, contains 17.5 repeats and induces expression of UPA ("upregulated by AvrBs3") genes, including the Bs3 resistance gene in pepper plants (Kay et al. (2007) Science 318:648-651; Romer et al. (2007) Science 318:645-648; Marois et al. (2002) Mol. Plant-Microbe Interact. 15:637-646). The number and order of repeats in an endogenous TAL effector have been shown to determine its specific activity (Herbers et al. (1992) Nature 356:172-174). The repeats were shown to be essential for DNA-binding of AvrBs3 and constitute a novel DNA-binding domain (Kay et al. (2007) Science 318:648-651). Amino acid sequences of endoegnous TALEs, as well as nucleic acid sequences encoding such amino acid sequences, are well known in the art. Some exemplary endogenous TALE polypeptide amino acid sequences are provided herein as SEQ ID NOs: 4-167, and include, but are not limited to, those from gene accession numbers AAW59491.1, AAQ79773.2, YP_450163.1, YP_001912778.1, ZP_02242672.1, AAW59493.1, AAY54170.1, ZP_02245314.1, ZP_02243372.1, AAT46123.1, AAW59492.1, YP_451030.1, YP_001915105.1, ZP_02242534.1, AAW77510.1, ACD11364.1, ZP_02245056.1, ZP_02245055.1, ZP_02242539.1, ZP_02241531.1, ZP_02243779.1, AAN01357.1, ZP_02245177.1, ZP_02243366.1, ZP_02241530.1, AAS58130.3, ZP_02242537.1, YP_200918.1, YP_200770.1, YP_451187.1, YP_451156.1, AAS58127.2, YP_451027.1, YP_451025.1, AAA92974.1, YP_001913755.1, ABB70183.1, YP_451893.1, YP_450167.1, ABY60855.1, YP_200767.1, ZP_02245186.1, ZP_02242931.1, ZP_02242535.1, AAY54169.1, YP_450165.1, YP_001913452.1, AAS58129.3, ACM44927.1, ZP_02244836.1, AAT46125.1, YP_450161.1, ZP_02242546.1, AAT46122.1, YP_451897.1, AAF98343.1, YP_001913484.1, AAY54166.1, YP_001915093.1, YP_001913457.1, ZP_02242538.1, YP_200766.1, YP_453043.1, YP_001915089.1, YP_001912981.1, ZP_02242929.1, YP_001911730.1, YP_201654.1, YP_199877.1, ABB70129.1, YP_451696.1, YP_199876.1, AAS75145.1, AAT46124.1, YP_200914.1, YP_001915101.1, ZP02242540.1, AAG02079.2, YP_451895.1, YP_451189.1, YP_200915.1, AAS46027.1, YP_001913759.1, YP_001912987.1, AAS58128.2, AAS46026.1, YP_201653.1, YP_202894.1, YP_001913480.1, ZP_02242666.1, YP_001912775.1, ZP_02242662.1, AAS46025.1, AAC43587.1, BAA37119.1, NP_644725.1, ABO77779.1, BAA37120.1, ACZ62652.1, BAF46271.1, ACZ62653.1, NP_644793.1, ABO77780.1, ZP_02243740.1, ZP_02242930.1, AAB69865.1, AAY54168.1, ZP_02245191.1, YP_001915097.1, ZP_02241539.1, YP_451158.1, BAA37121.1, YP_001913182.1, YP_200903.1, ZP_02242528.1, ZP_06705357.1, ZP_06706392.1, ADI48328.1, ZP_06731493.1, ADI48327.1, ABO77782.1, ZP_06731656.1, NP_942641.1, AAY43360.1, ZP_06730254.1, ACN39605.1, YP_451894.1, YP_201652.1, YP_001965982.1, BAF46269.1, NP_644708.1, ACN82432.1, ABO77781.1, P14727.2, BAF46272.1, AAY43359.1, BAF46270.1, NP_644743.1, ABG37631.1, AAB00675.1, YP_199878.1, ZP_02242536.1, CAA48680.1, ADM80412.1, AAA27592.1, ABG37632.1, ABP97430.1, ZP_06733167.1, AAY43358.1, 2KQ5_A, BAD42396.1, ABO27075.1, YP_002253357.1, YP_002252977.1, ABO27074.1, ABO27067.1, ABO27072.1, ABO27068.1, YP_003750492.1, ABO27073.1, NP_519936.1, ABO27071.1, ABO27070.1, and ABO27069.1, which are herein incorporated by reference in their entireties.

As described herein, the inventors have discovered novel methods for producing engineered TALE polypeptides, termed herein as "dTALE polypeptides," "designer TALEs," or "dTALEs" having a predetermined and specific amino acid sequence. dTALEs comprise a "nucleic acid binding domain" that recognizes and specifically binds a desired DNA target sequence and is comprised of tandem monomer units or tandem repeat units, as the terms are defined herein, as well as, in some embodiments, one or more additional domains for mediating an effector function, termed herein as "effector domains." Accordingly, novel dTALE polypeptides can be designed to bind a target nucleic acid sequence via a predetermined, modular arrangement of monomer units, each of which is responsible for the specific recognition of one base pair in a target DNA sequence, and constructed using the expression vectors and methods described herein. Also provided herein are nucleic acids molecules and expression vectors encoding such dTALE polypeptides, and compositions and kits comprising the same.

Accordingly, in some aspects, provided herein are compositions comprising dTALE polypeptides, such as isolated dTALE polypeptides, or biologically active portions thereof. As used herein, in reference to a nucleic acid molecule, polypeptide, protein or peptide, an "isolated" or "purified" nucleic acid molecule, polypeptide, protein or peptide is substantially free of cellular material when produced by recombinant DNA or in vitro techniques. The phrase "substantially free of cellular material," as used herein, refers to preparations of a dTALE polypeptide in which the protein is separated from cellular components of the cells in which it is produced. In some such embodiments, the phrase "substantially free of cellular material" refers to preparations of a dTALE polypeptide having less than about 30% (by dry weight) of non-dTALE polypeptide (also referred to herein as a "contaminating protein"), less than about 20% of a non-dTALE polypeptide, less than about 10% of non-dTALE polypeptide, less than about 5% non-dTALE polypeptide, less than about 3% non-dTALE polypeptide, less than about 1% non-dTALE polypeptide, or less.

It is also preferred that when the dTALE polypeptide or biologically active portion thereof is recombinantly produced, it is also substantially free of culture medium, i.e., culture medium represents less than about 20%, less than about 10%, less than about 5%, less than about 4%, less than about 3%, less than about 2%, less than about 1%, or less, of the volume of the protein preparation. The language "substantially free of chemical precursors or other chemicals" includes preparations of dTALE polypeptide in which the protein is separated from chemical precursors or other chemicals that are involved in the synthesis of the protein. In some embodiments, the language "substantially free of chemical precursors or other chemicals" includes preparations of dTALE protein having less than about 30% (by dry weight) of chemical precursors or non-dTALE chemicals, less than about 20% chemical precursors or non-dTALE chemicals, less than about 10% chemical precursors or non-dTALE chemicals, and less than about 5% chemical precursors or non-dTALE gamma chemicals. In certain embodiments, isolated proteins or biologically active portions thereof lack contaminating proteins from the same organism from which the dTALE polypeptide is derived. Typically, such proteins are produced by recombinant expression of, for example, a dTALE protein in a mammalian (e.g., human) cell.

In some embodiments of the aspects described herein, the isolated dTALE polypeptide or portion thereof specifically binds to a predetermined target nucleic acid sequence. In some embodiments of the aspects described herein, a dTALE polypeptide, or a monomer unit of a nucleic acid binding domain of a dTALE polypeptide, comprises an amino acid sequence shown in Tables 1-3 or comprises a sequence encoded by a nucleic acid sequence shown in Tables 1-3. In some embodiments of the aspects described herein, a dTALE polypeptide, or a monomer unit of a nucleic acid binding domain of a dTALE polypeptide, comprises an amino acid sequence that is at least about 50%, at least about 55%, at least about 60%, at least about 65%, at least about 70%, at least about 75%, at least about 80%, at least about 85%, at least about 90%, at least about 95%, at least about 99%, or more homologous to an amino acid sequence shown in Tables 1-3, or to an amino acid sequence encoded by a nucleic acid sequence shown in Tables 1-3. In other embodiments of the aspects described herein, the isolated dTALE polypeptide or portion thereof has an amino acid sequence that is encoded by a nucleotide sequence that hybridizes, e.g., hybridizes under stringent conditions, to a nucleotide sequence shown in, or encoding a protein provided in Tables 1-3, or is encoded by a nucleotide sequence that is at least about 50%, at least about 60%, at least about 70%, at least about 80%, at least about 90%, at least about 95%, or more, homologous to a nucleotide sequence shown in or encoding a protein provided in Tables 1-3.

In some embodiments of the aspects described herein, a dTALE nucleic acid molecule is provided that encodes a protein or portion thereof which includes an amino acid sequence which is sufficiently homologous to an amino acid sequence or to the amino acid sequence encoded by the nucleic acid sequence listed in Tables 1-3 such that the protein or portion thereof maintains the ability to specifically bind a predetermined nucleic acid sequence. Any and all such mutations are readily known to a person having ordinary skill in the art based upon the degeneracy of the genetic code and codon algorithms in a species of interest. In another embodiment, the protein is at least about 50%, 55%, 60%, 65%, 70%, 75%, 80%, 85%, 90%, 95%, 99% or more identical to the entire amino acid sequence or encoded by the nucleic acid sequence listed in Tables 1-3.

The sub-sections below further illustrate and describe exemplary component parts that can be used according to the methods provided herein to design dTALE polypeptides as described herein.

Nucleic Acid Binding Monomer Units

As described herein, dTALE polypeptides comprise a nucleic acid binding domain formed of tandem monomer units or tandem repeat units arranged in a specific and predetermined 5' to 3' order. Each such monomer unit of the nucleic acid binding domain has an affinity to bind a specific nucleotide and accordingly determines the recognition of a single base pair in a target nucleic acid sequence. Accordingly, the specific arrangement of monomer units in the nucleic acid binding domain of a dTALE polypeptide determines which target nucleic acid sequence the dTALE polypeptide can bind to. Thus, by selecting and arranging monomer units in a modular fashion, dTALE polypeptides can be constructed having a nucleic acid binding domain that specifically binds any predetermined and desired target nucleic acid sequence, as described herein.

The term "nucleic acid binding domain" is used herein to describe the DNA recognition domain of a dTALE polypeptide that is made using the methods provided herein. A nucleic acid binding domain comprises a series of tandemly arranged modular monomer units in a specific order that when present in a dTALE polypeptide confer specificity to a target DNA sequence. A nucleic acid binding domain comprised of monomer units can be added to any polypeptide in which DNA sequence targeting is desired, as described herein. A nucleic acid binding domain can further comprise amino acid sequences N-terminal and C-terminal of the tandemly arranged monomer units, such as those described in, for example, FIG. 6A.

As used herein, the terms "monomer unit" or "repeat unit" are used to describe the modular components of the nucleic acid binding domain of a dTALE polypeptide and have affinity to bind a specific nucleotide and accordingly determine the recognition of a single base pair in a target nucleic acid sequence. This recognition of a single base pair in a target nucleic acid sequence is mediated by one amino acid or two adjacent amino acid residues, typically at positions 12 and 13 of the modular unit of an endogenous TALE polypeptide, and are termed herein as "variable diresidues." Monomer units taken together recognize a defined target DNA sequence and constitute a nucleic acid binding domain, as used herein.

The individual monomer units that make up a nucleic acid binding domain differ from one another mainly at the amino acids corresponding to positions 12 and 13 of the monomer unit, termed herein as the "variable diresidues." The variable diresidues within each monomer unit of a nucleic binding domain of a dTALE polypeptide is responsible for recognition of one specific DNA base pair in a target DNA sequence. Within a monomer unit, the variable diresidues, typically corresponding to amino acid positions 12 and 13 of the monomer unit, are responsible for this recognition specificity. Hence, each variation in these amino acids reflects a corresponding variation in target DNA recognition and recognition capacity by a dTALE polypeptide of a particular nucleic acid sequence. It is recognized herein that positions 12 and 13 of a monomer unit correspond to or are equivalent to positions 12 and 13 of the full-length monomer units of the endogenous TALE molecule AvrBs3 and other endogenous or naturally occurring TALEs. One of ordinary skill in the art can readily determine such equivalent positions by aligning any monomer unit with a full-length monomer unit of AvrBs3, for example. An exemplary consensus sequence of a monomer unit having 34 amino acids (in one-letter code) is: LTPEQVVAIASNGGGKQALETVQRLLPVLCQAHG (SEQ ID NO: 1). Another exemplary consensus sequence for a monomer unit comprising 35 amino acids (in one-letter code) is:

```
                                         (SEQ ID NO: 2)
LTPEQVVAIASNGGGKQALETVQRLLPVLCQAPHD.
```

The variable diresidues of a monomer unit are the amino acids, typically amino acids 12 and 13 of the monomer unit that are responsible for affinity or specific binding of a monomer unit to a specific nucleotide according to the following code: NI to A (adenine nucleotide), HD to C (cytosine nucleotide), NG to T (thymine nucleotide), and NN to G (guanine nucleotide) or A (adenine nucleotide). According to the Examples described further herein, in some embodiments, the variable diresidues of a monomer unit can also comprise NS, NK, HG, HH, ND, SN, YG, HN, HA, SS, NA, NV, HI, NQ, NH, NC, IG, N, S, or H.

In some embodiments of the dTALE polypeptides or monomer units thereof described here, and methods of generating such dTALE polypeptides or monomer units described herein, the divariable residues within a monomer unit of a nuclear acid binding domain can be selected from the following residue for recognition of the indicated nucleotide(s): HD for recognition of C/G; NI for recognition of A/T; NG for recognition of T/A; NS for recognition of C/G or A/T or T/A or G/C; NN for recognition of G/C or A/T; IG for recognition of T/A; N for recognition of C/G or T/A; HG for recognition of T/A; H for recognition of T/A; NK for recognition of G/C; NH for recognition of G/C; NP for recognition of A/T or C/G or T/A; NT for recognition of A/T or G/C; HN for recognition of A/T or G/C; SH for recognition of G/C; SN for recognition of G/C and IS for recognition of A/T. Exemplary monomer units comprising such divariable residues can be found, for example, at US Patent Publication 20110239315, the contents of which are herein incorporated in their entireties by reference.

The number of monomer units within a given dTALE polypeptide and the 5' to 3' order of those monomer units determines the corresponding predetermined nucleic acid sequence recognized by the nucleic acid binding domain.

The number and predetermined 5' to 3' order of monomer units determines the corresponding activity and DNA recognition specificity of a dTALE polypeptide. The number of monomer units to be used or included in a nucleic acid binding domain of a dTALE polypeptide can be ascertained by one skilled in the art by routine experimentation, and depends, in part, on the length of nucleic acid sequence to be targeted by the dTALE polypeptide. Generally, at least 1.5 monomer units are considered as a minimum, although typically at least about 8 monomer units are used. The monomer units do not have to be complete monomer units, as monomer units of half the size or length can be used, particularly if they are present at the C-terminus of the nucleic acid binding domain of a dTALE polypeptide. Thus, a dTALE polypeptide as described herein can comprise, for example, at least about 1.5, at least about 2, at least about 2.5, at least about 3, at least about 3.5, at least about 4, at least about 4.5, at least about 5, at least about 5.5, at least about 6, at least about 6.5, at least about 7, at least about 7.5, at least about 8, at least about 8.5, at least about 9, at least about 9.5, at least about 10, at least about 10.5, at least about 11, at least about 11.5, at least about 12, at least about 12.5, at least about 13, at least about 13.5, at least about 14, at least about 14.5, at least about 15, at least about 15.5, at least about 16, at least about 16.5, at least about 17, at least about 17.5, at least about 18, at least about 18.5, at least about 19, at least about 19.5, at least about 20, at least about 20.5, at least about 21, at least about 21.5, at least about 22, at least about 22.5, at least about 23, at least about 23.5, at least about 24, at least about 24.5, at least about 25, at least about 25.5, at least about 26, at least about 26.5, at least about 27, at least about 27.5, at least about 28, at least about 28.5, at least about 29, at least about 29.5, at least about 30, at least about 30.5, at least about 31, at least about 31.5, at least about 32, at least about 32.5, at least about 33, at least about 33.5, at least about 34, at least about 34.5, at least about 35, at least about 35.5, at least about 36, at least about 36.5, at least about 37, at least about 37.5, at least about 38, at least about 38.5, at least about 39, at least about 39.5, at least about 40, at least about 40.5, at least about 41, at least about 41.5, at least about 42, at least about 42.5, at least about 43, at least about 43.5, at least about 44, at least about 44.5, at least about 45, at least about 45.5, at least about 46, at least about 46.5, at least about 47, at least about 47.5, at least about 48, at least about 48.5, at least about 49, at least about 49.5, at least about 50, at least about 50.5, or more monomer units. For example, the nucleic acid binding domain can be engineered in a 5' to 3' direction to comprise 1, 2, 3, 4, 5, 6, 7, 8, 9, 10, 11, 12, 13, 14, 15, 16, 17, 18, 19, 20, 21, 22, 23, 24, 25, or more same or different monomer units to thereby specifically bind to a predetermined 1, 2, 3, 4, 5, 6, 7, 8, 9, 10, 11, 12, 13, 14, 15, 16, 17, 18, 19, 20, 21, 22, 23, 24, 25-base pair target nucleic acid sequence. In some embodiments of the aspects described herein, a dTALE polypeptide comprises about 8 and to about 39 repeat units. In some embodiments of the aspects described herein, a dTALE polypeptide comprises about 11.5 to about 33.5 repeat units. Moreover, in some embodiments of the aspects described, the most 5' monomer unit of the dTALE polypeptide is selected such that it specifically binds to a thymine.

The number and predetermined 5' to 3' order of monomer units of the nucleic acid binding domain determines what nucleic acid sequence(s) a dTALE polypeptide specifically binds to, i.e., the target DNA sequence of a dTALE polypeptide. As used herein, "specifically binds" means that the binding affinity of the nucleic acid binding domain of a dTALE polypeptide described herein to a specified, predetermined target DNA sequence is detectably or statistically higher than the binding affinity of the same dTALE polypeptide to a generally comparable, but non-target DNA sequence. The binding affinity of the nucleic acid binding domain of a dTALE polypeptide to a nucleic acid sequence can be determined using any means known to one of ordinary skill in the art, including, but not limited to, the methods described herein. For the nucleic acid binding domain of a dTALE polypeptide to be said to specifically bind to a target nucleic acid sequence, it is preferred that the binding affinity is detectably or measurably higher by at least 1.5-fold, at least 2-fold, at least 3-fold, at least 4-fold, at least 5-fold, at least 6-fold, at least 7-fold, at least 8-fold, at least 9-fold, at least 10-fold, at least 11-fold, at least 12-fold, at least 13-fold, at least 14-fold, at least 15-fold, at least 16-fold, at least 17-fold, at least 18-fold, at least 19-fold, at least 20-fold, or more relative to its binding to non-target nucleic acid sequences, including to the substantial exclusion of non-target DNA sequences. The $K_d$ of a dTALE polypeptide for two or more DNA sequences can be determined and compared to assess the binding specificity of the dTALE polypeptide to a particular target DNA sequence. Binding of a dTALE nucleic acid-binding domain to a predetermined nucleic acid sequence can be measured and detected in a variety of ways, including, but not limited to, gel shift assays and the use of radiolabeled, fluorescent or enzymatic labels that can be detected after binding to the target sequence, and the use of reporter plasmid assays, as described herein (see, for example, FIG. 1C).

A dTALE polypeptide binds a target nucleic acid sequence or target DNA sequence based on the order and number of monomer units in its nucleic acid binding domain. Accordingly, as used herein, a "target nucleic acid sequence" refers to a portion of a double-stranded nucleic acid, such as a DNA molecule, to which recognition by the dTALE polypeptide is desired. A "target nucleic acid sequence" can be any nucleic acid sequence desired to be targeted, and includes, for example, a nucleic acid molecule or portion thereof that comprises a coding sequence of a gene, intronic regions of a gene sequence, nucleic acid sequences that encode for non-translated RNA molecules, such as siRNAs, tRNAs, microRNAs and the like, and transcriptional and translational control regions of a gene that regulate expression of the coding sequence of a gene. Such control regions include, but are not limited to, regulatory sequences, such as promoters, enhancers, 5' untranslated regions, 3' untranslated regions, termination signals, poly adenylation regions, and the like. Regulatory sequences of a gene can be located proximal to, within, or distal to the coding region.

In some embodiments of the dTALE polypeptides described herein, a "target nucleic acid sequence" that a dTALE polypeptide specifically binds comprises all or part of a transcriptional control element of a gene, such that, for example, binding of the dTALE polypeptide, via its nucleic acid binding domain, to the transcriptional control element alters the gene's degree of expression and achieves a desired phenotypic result. A "transcriptional control element," as used herein, refers to nucleic acid sequences that include, but are not limited to, positive and negative control elements, such as promoters, enhancers, other response elements, e.g., steroid response elements, heat shock response elements, metal response elements, repressor binding sites, operators, and/or silencers. A transcriptional control element can be viral, eukaryotic, or prokaryotic in origin.

In some embodiments of the aspects described herein, a dTALE polypeptide, or a nucleic acid encoding such a dTALE polypeptide, is designed to comprise a nucleic acid binding domain in which one or more monomer units comprises a sequence of an endogenous TALE molecule's monomer units. In some such embodiments of the dTALE polypeptides described herein, a monomer unit or a nucleic acid binding domain can comprise a amino acid sequence, or be encoded by a nucleic acid sequence, that is at least about 50%, at least about 55%, at least about 60%, at least about 65%, at least about 70%, at least about 75%, at least about 80%, at least about 85%, at least about 90%, at least about 95%, at least about 96%, at least about 96.5%, at least about 97%, at least about 97.5%, at least about 98%, at least about 98.5%, at least about 99%, at least about 99.5%, at least about 99.6%, at least about 99.7%, at least about 99.8%, at least about 99.9%, or 100% homologous to an amino acid sequence encoding an endogenous TALE protein (SEQ ID NOs: 4-167) of Table 1, a nucleotide sequence encoding a monomer unit of Table 2 (SEQ ID NOs: 168-191) or Table 3 (SEQ ID NOs: 196-203), or portions thereof, such as one or more monomer units of the endogenous TALE proteins (SEQ ID NOs: 4-167) of Table 1, portions of the sequences encoding a monomer unit of Table 2 (SEQ ID NOs: 168-191) or Table 3 (SEQ ID NOs: 196-203), comprising, for example, 9, 12, 15, 18, 21, 24, 27, 30, 33, 36, 39, 42, 45, 48, 51, 54, 57, 60, 63, 66, 69, 72, 75, 78, 81, 84, 87, 90, 93, 96, 99, 102, 105 or more amino acids of an endogenous TALE protein (SEQ ID NOs: 4-167) of Table 1 or monomer units of Tables 2 and 3 (SEQ ID NOs: 168-191 and 196-203). Nucleic acid sequences encoding endogenous TALE molecules, or portions thereof, such as sequences encoding one or more monomer units of an endogenous TALE molecule, can be isolated using standard molecular biology techniques, using the sequence information provided herein, sequence information available to a skilled artisan from publicly available databases and repositories, or any combination thereof. For example, an endogenous TALE hax 3 gene can be isolated from a *Xanthomonas campestris* pv. *armoraciae* bacterium using all or portion of an amino acid sequence of the proteins shown at Table 1, or the sequences encoding monomer units shown at Tables 2-3, as a hybridization probe and standard hybridization techniques (i.e., as described in Sambrook, J., Fritsh, E. F., and Maniatis, T. *Molecular Cloning: A Laboratory Manual. 2nd, ed., Cold Spring Harbor Laboratory*, Cold Spring Harbor Laboratory Press, Cold Spring Harbor, N.Y., 1989).

As will be understood by one of ordinary skill in the art, different segments or portions of the dTALE polypeptides or nucleic acid molecules encoding the dTALE polypeptides described herein can have sequence homology with different, unrelated protein molecules. Accordingly, in some embodiments of the dTALE polypeptides described herein, one or more monomer units of the nuclear binding domain share sequence homology with a monomer unit of one or more endogenous TALE molecules, while the effector domain shares sequence homology with a domain of a different molecule, such as a transcription factor.

The terms "sequence identity" or "sequence homology," as used herein, refer to the degree of sequence similarity between two polypeptide molecules or between two nucleic acid molecules. When a position in both of two compared sequences is occupied by the same base or amino acid, e.g., if a position in each of two DNA molecules is occupied by adenine, then the molecules are homologous or sequence identical at that position. The percent of homology or sequence identity between two sequences is a function of the number of matching or homologous identical positions shared by the two sequences divided by the number of positions compared×100. For example, if 6 out of 10 of the positions in two sequences are the same, then the two sequences are 60% homologous or have 60% sequence identity. By way of example, the DNA sequences ATTGCC and TATGGC share 50% homology or sequence identity. Generally, comparisons of sequence homology or sequence identity are made when two sequences are aligned to give maximum homology. Unless otherwise specified, "loop out regions," of a sequence, e.g., those arising from deletions or insertions in one of the sequences are counted as mismatches.

The comparison of sequences and determination of percent homology between two sequences can be accomplished using a mathematical algorithm, as known to one of skill in the art. Alignments can be performed, for example, using the Clustal Method. Multiple alignment parameters include, for example, GAP Penalty=10, Gap Length Penalty=10. For DNA alignments, the pairwise alignment parameters used can be, for example, Htuple=2, Gap penalty=5, Window=4, and Diagonal saved=4. For protein alignments, the pairwise alignment parameters used can be, for example, Ktuple=1, Gap penalty=3, Window=5, and Diagonals Saved=5.

In certain embodiments of the aspects described herein, percent identity or percent homology between two amino acid sequences can be determined using the Needleman and Wunsch (*J. Mol. Biol*. (48):444-453 (1970)) algorithm which has been incorporated into the GAP program in the GCG software package (available on the world wide web), using either a Blossom 62 matrix or a PAM250 matrix, and a gap weight of, for example, 16, 14, 12, 10, 8, 6, or 4 and a length weight of, for example, 1, 2, 3, 4, 5, or 6. In other embodiments of the aspects described herein, the percent identity between two nucleotide sequences can be determined using the GAP program in the GCG software package (available on the world wide web), using a NWSgapdna.CMP matrix and a gap weight of, for example, 40, 50, 60, 70, or 80, and a length weight of, for example, 1, 2, 3, 4, 5, or 6. In some embodiments, percent identity or percent homology between two amino acid or nucleotide sequences can be determined using the algorithm of E. Meyers and W. Miller (CABIOS, 4:11-17 (1989)) which has been incorporated into the ALIGN program (version 2.0) (available on the world wide web), using, for example, a PAM120 weight residue table, a gap length penalty of 12 and a gap penalty of 4.

A nucleic acid molecule encoding all or a portion of the amino acid sequence of any of the endogenous TALE polypeptides or monomer units shown at Tables 1-3, or a nucleotide sequence that encodes all or a portion of an amino acid sequence that is at least about 50%, at least about 55%, at least about 60%, at least about 65%, at least about 70%, at least about 75%, at least about 80%, at least about 85%, at least about 90%, at least about 95%, at least about 96%, at least about 96.5%, at least about 97%, at least about 97.5%, at least about 98%, at least about 98.5%, at least about 99%, at least about 99.5%, at least about 99.6%, at least about 99.7%, at least about 99.8%, at least about 99.9%, or 100% homologous to the amino acid sequence of any of the endogenous TALE polypeptides or monomer units shown at Tables 1-3, can be isolated using a number of well-known non-hybridization techniques. Such techniques include, but are not limited to, polymerase chain reaction (PCR) and/or site-directed mutagenesis using oligonucleotide primers designed based upon the amino acid sequences of the endogenous TALE polypeptides or monomer units shown in Tables 1-3, the nucleotide sequences encoding the endogenous TALE polypeptides or monomer units shown in Tables 1-3, and/or amino acid or nucleotide sequences having the desired homology to the amino acid sequences of the endogenous TALE polypeptides or monomer units shown in Tables 1-3. Oligonucleotides can be prepared by standard synthetic techniques known to one of ordinary skill in the art, e.g., using an automated DNA synthesizer.

Isolated nucleic acid molecules can be used in hybridization or amplification assays that include, but are not limited to, Southern or Northern analyses, polymerase chain reaction analyses and probe arrays to assess nucleic acid binding properties according to methods well known in the art. Nucleic acid amplification methods can be useful in combination with such assays. Specific examples of such amplification techniques include, but are not limited to PCR (the experimental embodiment set forth in Mullis, 1987, U.S. Pat. No. 4,683,202), ligase chain reaction (Barany, 1991, *Proc. Natl. Acad. Sci. USA,* 88:189-193), self sustained sequence replication (Guatelli et al., 1990*, Proc. Natl. Acad. Sci. USA* 87:1874-1878), transcriptional amplification system (Kwoh et al., 1989*, Proc. Natl. Acad. Sci. USA* 86:1173-1177), Q-Beta Replicase (Lizardi et al., 1988*, Bio/Technology* 6:1197), and rolling circle replication (Lizardi et al., U.S. Pat. No. 5,854,033). In addition or alternatively, quantitation of nucleic acid binding using reporter expression systems can be used. Well known examples include the use of analytic biochemical methods such as electrophoresis, capillary electrophoresis, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, Western blotting, and the like. A skilled artisan can readily adapt known protein/antibody detection methods for use in determining reporter results.

Due to the highly repetitive nature of the nuclear binding domains and component monomer units of the dTALE polypeptides described herein, dTALE polypeptides are typically produced by recombinant DNA techniques, as opposed to chemical synthesis. To minimize sequence repetitiveness, codons encoding the amino acids of each monomer unit of a dTALE polypeptide are designed and engineered to minimize sequence repetitiveness among the monomer units encoded by the nucleic acid molecule. For example, if leucine is encoded at a specific position in each of a string of seven monomer units used in a nucleic acid binding domain, then the six independent codons for leucine can be used for each of six monomers and one leucine codon can be repeated for the seventh monomer, as described herein.

A skilled artisan can engineer reductions in such repetitiveness of the codons encoding the amino acids of each monomer unit of a dTALE polypeptide, since there is a known and definite correspondence between the amino acid sequence of a particular protein and the nucleotide sequences that can code for the protein, as defined by the genetic code, as shown below. Similarly, there is a known and definite correspondence between the nucleotide sequence of a particular nucleic acid and the amino acid sequence encoded by that nucleic acid, as defined by the genetic code.

GENETIC CODE

| | |
|---|---|
| Alanine (Ala, A) | GCA, GCC, GCG, GCT |
| Arginine (Arg, R) | AGA, ACG, CGA, CGC, CGG, CGT |
| Asparagine (Asn, N) | AAC, AAT |
| Aspartic acid (Asp, D) | GAC, GAT |
| Cysteine (Cys, C) | TGC, TGT |
| Glutamic acid (Glu, E) | GAA, GAG |
| Glutamine (Gln, Q) | CAA, CAG |
| Glycine (Gly, G) | GGA, GGC, GGG, GGT |
| Histidine (His, H) | CAC, CAT |
| Isoleucine (Ile, I) | ATA, ATC, ATT |
| Leucine (Leu, L) | CTA, CTC, CTG, CTT, TTA, TTG |
| Lysine (Lys, K) | AAA, AAG |
| Methionine (Met, M) | ATG |
| Phenylalanine (Phe, F) | TTC, TTT |
| Proline (Pro, P) | CCA, CCC, CCG, CCT |
| Serine (Ser, S) | AGC, AGT, TCA, TCC, TCG, TCT |
| Threonine (Thr, T) | ACA, ACC, ACG, ACT |
| Tryptophan (Trp, W) | TGG |
| Tyrosine (Tyr, Y) | TAC, TAT |
| Valine (Val, V) | GTA, GTC, GTG, GTT |
| Termination signal (end) | TAA, TAG, TGA |

An important and well known feature of the genetic code is its redundancy, whereby, for most of the amino acids used to make proteins, more than one nucleotide triplet encoding an amino acid upon translation can be employed, as shown above. Therefore, a number of different nucleotide sequences can code for a given amino acid sequence. Such nucleotide sequences are considered functionally equivalent since they result in the production of the same amino acid sequence in all organisms, although, for example, certain organisms can translate some nucleotide sequences more efficiently than they do others. Moreover, occasionally, a methylated variant of a purine or pyrimidine can be found in a given nucleotide sequence. Such methylations do not affect the coding relationship between the trinucleotide codon and the corresponding amino acid. Accordingly, in some embodiments of the various aspects described herein, a nucleic acid molecule that encodes one or monomer units, or encodes a nucleic acid binding domain of a dTALE polypeptide, differs, due to degeneracy of the genetic code, from the nucleotide sequence of a nucleic acid molecule encoding an endogenous TALE or monomer unit, such as those provided in Table 1-3, yet encodes the same amino acid sequence of the one or monomer units, or encodes the same amino acid sequence of the nucleic acid binding domain of the endogenous TALE molecule.

The dTALE polypeptides described herein can further comprise, in some embodiments, one or more "variant monomer units" of an endogenous TALE molecule. Accordingly, in some embodiments of the aspects described herein, variant monomer units of endogenous TALEs, or nucleic acid molecules encoding variant monomer units of endogenous TALEs, such as the endogenous TALEs (SEQ ID NOs: 4-167) provided in Tablet, are also contemplated. As used herein, a "variant monomer unit," refers to a monomer unit having one or more amino acid differences from the amino acid sequence of a monomer unit found in an endogenous TALE molecule, such that the variant monomer unit retains the ability to specifically bind the same nucleic acid as the monomer unit found in the endogenous TALE molecule. Such amino acid differences include conservative substitution variants, non-conservative substitution variants, amino acid deletions, amino acid additions, or any combination thereof. In some such embodiments of the dTALE polypeptide described herein, a variant monomer unit is at least about 50%, at least about 55%, at least about 60%, at least about 65%, at least about 70%, at least about 75%, at least about 80%, at least about 85%, at least about 90%, at least about 95%, or more, homologous to the amino acid sequence of any of a monomer unit of an endogenous TALE polypeptide, such as the endogenous TALE polypeptides provided in Table 1.

The monomer units or nucleic acid binding domain of the dTALE polypeptides described herein can comprise an amino acid sequence, or be encoded by a nucleic acid molecule, that differs from an amino acid sequence or nucleotide sequence encoding an endogenous TALE molecule provided in Table 1, or portions thereof, due to degeneracy of the genetic code and thus encode a dTALE poplypeptide in a number of ways readily understood by one of ordinary skill in the art.

Further, as described herein, changes to the amino acid sequence or nucleotide sequence of a dTALE polypeptide can be introduced by, for example, mutating an amino acid sequence of a protein or a nucleic acid sequence encoding an endogenous TALE polypeptide or monomer unit of Tables 1-3, thereby leading to changes in the amino acid sequence of the encoded dTALE polypeptide, without altering the functional ability of the dTALE to specifically bind a predetermined nucleic acid sequence. For example, in some embodiments, nucleotide substitutions leading to amino acid substitutions at "non-essential" amino acid residues of a monomer unit can be made into a sequence encoding a dTALE polypeptide. As used herein, a "non-essential" amino acid residue is a residue of a monomer unit or nucleic acid binding domain of a dTALE polypeptide that can be altered from the natural sequence of an endogenous TALE molecule (for example, the amino acid sequences of, or the nucleic acid sequences encoding the endogenous TALE molecules listed in Table 1) without altering the ability to specifically bind a predetermined nucleotide or nucleic acid sequence, whereas an "essential" amino acid residue, as used herein, is one that is required for specifically binding a predetermined nucleic acid sequence or predetermined nucleotide. Amino acid residues outside positions 12 and 13 of the monomer unit of an endogenous TALE molecule, i.e., the variable residues, are believed to not be essential for specifically binding a predetermined nucleic acid sequence or predetermined nucleotide and are therefore considered likely to be amenable to alteration.

Accordingly, an isolated nucleic acid molecule encoding a dTALE polypeptide or portions thereof, such as one or more monomer units, homologous to an endogenous TALE molecule, provided, for example, in Table 1, or a portion thereof, such as a monomer unit, such as those provided in Tables 2-3, can be created by introducing one or more nucleotide substitutions, additions, or deletions into a nucleotide sequence shown in or encoding a protein or monomer unit provided in Tables 1-3, or portions thereof, or by introducing one or more nucleotide substitutions, additions, or deletions into a nucleotide sequence homologous to a nucleotide sequence provided in or encoding a protein or monomer unit described in Tables 1-3, or portions thereof, such that one or more amino acid substitutions, additions, or deletions are introduced into the dTALE polypeptide or monomer unit encoded by the isolated nucleic acid molecule. Such mutations can be introduced into nucleotide sequences shown in or encoding the polypeptides or monomer units in Tables 1-3 by standard techniques, such as site-directed mutagenesis and PCR-mediated mutagenesis.

In some embodiments of the dTALE polypeptides described herein, one or more conservative amino acid substitutions are made at one or more predicted non-essential amino acid residues of one or more monomer units of the nucleic acid binding domain. A "conservative amino acid substitution," as used herein, refers to an amino acid substitution in which a given amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, for example, a predicted nonessential amino acid residue in a monomer unit of a dTALE polypeptide can be replaced with another amino acid residue from the same side chain family.

Alternatively, in other embodiments, one or more mutations can be introduced randomly along the entire sequence or a portion thereof, such as a monomer unit, of an endogenous or known TALE molecule, such as by, for example, saturation mutagenesis, and the resultant polypeptides can be screened for specific binding to a predetermined nucleic acid sequence to identify those mutants that retain the ability to specifically bind to the desired predetermined nucleic acid sequence. For example, following mutagenesis of an amino acid sequence or a nucleic acid sequence shown in Tables 1-3, the encoded protein can be expressed recombinantly, using any of the methods or compositions described herein, and the activity of the resulting polypeptide can be determined using, for example, assays as described herein.

As used herein, the twenty conventional amino acids and their abbreviations follow conventional usage. See, for example, Immunology—A Synthesis (2nd Edition, E. S. Golub and D. R. Gren, Eds., Sinauer Associates, Sunderland, Mass. (1991)), which is incorporated herein by reference. The term "amino acid" or "amino acid residue," as used herein, refers to naturally occurring L amino acids or to D amino acids. The commonly used one- and three-letter abbreviations for amino acids are used herein (Bruce Alberts et al., Molecular Biology of the Cell, Garland Publishing, Inc., New York (4th ed. 2002)). Stereoisomers (e.g., D-amino acids) of the twenty conventional amino acids, unnatural amino acids such as alpha, alpha-disubstituted amino acids, N-alkyl amino acids, lactic acid, and other unconventional amino acids can also be suitable components for dTALE polypeptides as described herein. Examples of unconventional amino acids include, but are not limited to, 4-hydroxyproline, gammacarboxyglutamate, epsilon-N,N,N-trimethyllysine, epsilon-N-acetyllysine, O-phosphoserine, N-acetylserine, N-formylmethionine, 3-methylhistidine, 5-hydroxylysine, sigma-N-methylarginine, and other similar amino acids and imino acids (e.g., 4-hydroxyproline). In the polypeptide notations used herein, the left-hand direction is the amino terminal direction (N-terminal) and the right-hand direction is the carboxy-terminal (C-terminal) direction, in accordance with standard usage and convention.

In some embodiments of the aspects described herein, a monomer unit of a nucleic acid binding domain of a dTALE polypeptide comprises an amino acid sequence substantially homologous to the amino acid sequences of the endogenous TALE polypeptides or monomer units provided in Tables 1-3, for example SEQ ID NOs: 4-192 and SEQ ID NOs: 196-203, and can specifically bind to a predetermined nucleic acid sequence, yet differs in amino acid sequence due to natural allelic variation or mutagenesis, as described in detail herein.

In some embodiments of the aspects described herein, the monomer unit of the nucleic acid binding domain of a dTALE polypeptide comprises a biologically active fragment derived from the amino acid sequence of a endogenous TALE molecule, e.g., the amino acid sequences shown in Table 1 or encoded by the nucleic acid sequences provided in Tables 2-3, or a biologically active fragment derived from an amino acid sequence of a protein homologous to the amino acid sequences of endogenous TALE molecules or monomer unit shown in Tables 1-3. Typically, biologically active portions of the monomer units of the nucleic acid binding domain of a dTALE polypeptide comprises at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, or at least 35 amino acids, and require the variable diresidue positions of amino acids number 12 and 13 of the monomer unit from which it is derived from.

Due to the highly repetitive nature of the nuclear binding domain of dTALE polypeptides, they are typically produced by recombinant DNA techniques, as opposed to chemical synthesis, as described elsewhere herein. For example, in some embodiments of the aspescts described herein, a nucleic acid molecule encoding a dTALE polypeptide is cloned into an expression vector, such as for example, an expression vector comprising a backbone sequence of SEQ ID NOs: 192-195 as described herein, the expression vector is introduced into a host cell, as described herein, and the dTALE polypeptide is expressed by the host cell. The dTALE polypeptide can then be isolated from the cells by an appropriate purification scheme using standard protein purification techniques, as described herein and known to one of ordinary skill in the art.

Effector Domains

As described herein, dTALE polypeptides can further comprise, in addition to the nucleic acid binding domain, one or more effector domains. By combining a nucleic acid binding domain with one or more effector domains, a dTALE polypeptide can be used to target the one or more functions or activities mediated by the effector domain to a particular target DNA sequence to which the nucleic acid binding domain specifically binds. Accordingly, the term "effector domain," as used herein refers to a polypeptide sequence or domain sequence that has an activity other than specifically binding to the target nucleic acid sequence recognized by the nucleic acid binding domain of the dTALE polypeptide. Such dTALE polypeptides comprising one or more effector domains can also referred to as "chimeric dTALE polypeptides," or "fusion proteins having the dTALE binding domain." Accordingly, as used herein, a "chimeric dTALE polypeptide" or "fusion protein having the dTALE binding domain" has a nucleic acid binding domain operatively linked to one or more polypeptide sequences or domain sequences that do not comprise a nucleic acid binding domain having dTALE activity. In reference to chimeric dTALE polypeptides or fusion proteins having the dTALE binding domain, the term "operatively linked" is intended to indicate that the dTALE polypeptide and the domain or sequence from a non-dTALE polypeptide are fused in-frame to each other. The non-dTALE polypeptide can be fused to the N-terminus and/or C-terminus of the nucleic acid binding domain of the dTALE polypeptide. A "dTALE polypeptide" refers to a polypeptide having an amino acid sequence corresponding to a dTALE, whereas a "non-dTALE polypeptide" refers to a polypeptide having an amino acid sequence corresponding to a protein which is not substantially homologous to the dTALE protein, e.g., a protein which is different from the dTALE protein and which is derived from the same or a different organism.

In some embodiments of the dTALE polypeptides described herein, the activity mediated by the effector domain is a biological activity. Such biological activity mediated by the effector domain includes, but is not limited to, transposase activity, integrase activity, recombinase activity, resolvase activity, invertase activity, protease activity, DNA methyltransferase activity, DNA demethylase activity, histone acetylase activity, histone deacetylase activity, nuclease activity, nuclear-localization signaling activity, transcriptional repressor activity, transcriptional activator activity, transcription factor recruiting activity, cellular uptake signaling activity, antibody presentation activity, or any combination thereof. Non-limiting examples of molecules having biological activities useful in the effector domains described herein includes transposases, integrases, recombinases, resolvases, invertase, proteases, DNA methyltransferases, DNA demethylases, histone acetylases, histone deacetylases, nucleases, transcriptional repressors, transcriptional activators, a nuclear-localization signals, transcription-protein recruiting proteins, or any combination thereof. Thus, in some embodiments, a nucleic acid binding domain of a dTALE polypeptide is fused to an effector domain having any of these activities, such as, for example, effector domains derived from molecules having enzymatic activity, such as transposases, integrases, recombinases, resolvases, invertases, proteases, DNA methyltransferases, DNA demethylases, histone acetylases, histone deacetylases, nucleases; effector domains derived from molecules having regulatory activity, such as transcriptional repressors, transcriptional activators, transcription factor recruiting protein nuclear-localization signals, or molecules having other activities, such as those involved in providing cellular uptake signals.

In some embodiments, the activity mediated by the effector domain is a non-biological activity, such as a fluorescence activity, luminescence activity, or binding activity, such as those mediated by maltose binding protein ("MBP"), glutathione S transferase (GST), hexahistidine (SEQ ID NO: 315), c-myc, and the FLAG epitope, for facilitating detection, purification, monitoring expression, and/or monitoring cellular and subcellular localization of a dTALE polypeptide. In such embodiments, the dTALE polypeptide can also be used as a diagnostic reagent, for example, to detect mutations in gene sequences, to purify restriction fragments from a solution, or to visualize DNA fragments of a gel.

The one or more effector domains can be fused to the nucleic acid binding domain of a dTALE polypeptide such that it is at the N-terminus, C-terminus, or internal to the dTALE polypeptide, so long as it is not located within the dTALE nucleic acid binding domain. The positioning of an effector domain for activity (e.g., enhanced or optimal activity) can be engineered according to structural position requirements and methods well known in the art. In certain host cells (e.g., mammalian host cells), expression and/or secretion of dTALEs can be increased through use of a heterologous signal sequences.

In some embodiments of the dTALE polypeptides described herein, the one or more effector domains comprises an N-terminal domain 5' or a C-terminal domain 3', or a fragment or polypeptide sequence thereof that is at least 50%, at least 55%, at least 60%, at least 65%, at least 70%, at least 75%, at least 80%, at least 85%, at least 90%, at least 95%, at least 99%, or more identical to the amino acid sequence of the N-terminal domain and/or C-terminal domain from an endogenous transcription activator-like effector (TALE) polypeptide. In other words, the N-terminal and/or C-terminal amino acid sequences that flank the central nucleic acid binding domain comprising monomer units of an endogenous TALE molecule, such as, for example, a TALE amino acid sequence or nucleic acid sequence encoding a TALE provided in Table 1. In such embodiments, the N-terminal and/or C-terminal domains or a fragment or polypeptide sequence thereof can be selected to enhance the biological activity of another effector domain, such as, for example, to enhance transcriptional activation of a transcriptional activation effector domain.

Generally, as demonstrated herein, truncating the N-terminal domain of an endogenous TALE molecule reduces the enhancement of biological activity of another effector domain in a dTALE polypeptide, although such truncations can still enhance such effector domain activity relative to controls (e.g., cells transfected only with reporter constructs and lacking dTALE constructs). As used herein in regard to the impact of a domain, such as an N-terminal or C-terminal domain of an endogenous TALE molecule, on another domain's activity, "enhancing activity" or "enhancing biological activity" means and includes reference to promoting or increasing the activity or binding of the nucleic acid binding domain of adTALE polypeptide, or the activity of an effector domain of a dTALE polypeptide at a desired target nucleic acid sequence to a detectably greater degree, e.g., at least 1.5 fold, at least 2 fold, at least 3 fold, at least 4 fold, at least 5 fold, at least 6 fold, at least 7 fold, at least 8 fold, at least 9 fold, at least 10 fold, at least 11 fold, at least 12 fold, at least 13 fold, at least 14 fold, at least 15 fold, at least 16 fold, at least 17 fold, at least 18 fold, at least 19 fold, at least 20 fold or more-fold over background, than such nucleic acid binding domain's activity or effector domain's activity in the absence of the domain, such as the N-terminal and/or C-terminal domains.

In some such embodiments of the dTALE polypeptides described herein, the N-terminal domain used in a dTALE polypeptide can comprise 10, 15, 20, 30, 40, 50, 60, 70, 80, 90, 100, 110, 120, 130, 140, 150, 160, 170, 180, 190, 200, 210, 220 or more contiguous amino acids of the N-terminal domain of an endogenous TALE molecule, alone or in combination with one or more alterations in sequence described herein. In some such embodiments, the N-terminal domain comprises 10, 15, 20, 30, 40, 50, 60, 70, 80, 90, 100, 110, 120, 130, 140, 150, 160, 170, 180, 190, 200, 210, 220 or more contiguous amino acids of the N-terminal domain of the endogenous hax3 TALE (SEQ ID NO: 256). In some such embodiments, the N-terminal domain comprises amino acids 49-288 of the N-terminal domain of the endogenous hax3 TALE (SEQ ID NO: 256).

As demonstrated herein, similar effects on enhancement of biological activity of another effector domain of a dTALE polypeptide is generally observed for truncations of the TALE C-terminal domain. In some embodiments, the C-terminal domain used in a dTALE polypeptide can comprise 10, 15, 20, 30, 40, 50, 60, 70, 80, 90, 100, 110, 120, 130, 140, 150, 160, 170, 180, 190, 200, 210, 220 or more contiguous amino acids of the C-terminal domain of an endogenous TALE molecule, alone or in combination with alterations in sequence described above. In some such embodiments, the N-terminal domain comprises 10, 15, 20, 30, 40, 50, 60, 70, 80, 90, 100, 110, 120, 130, 140, 150, 160, 170, 180, 190, 200, 210, 220 or more contiguous amino acids of the C-terminal domain of the endogenous hax3 TALE (SEQ ID NO: 257). In some such embodiments, the CN-terminal domain comprises amino acids 1-68 of the C-terminal domain of the endogenous hax3 TALE (SEQ ID NO: 257).

In some embodiments, combinations of any described N-terminal domain of an endogenous TALE molecule with any described C-terminal domain of an endogenous TALE molecule are also contemplated for use in the dTALE polypeptides.

As described herein, dTALE polypeptides comprising a nucleic acid binding domain and an effector domain (such as a mammalian effector domain) are useful for targeting a specific protein activity to a locale having a predetermined nucleic acid sequence.

In some embodiments of the aspects described herein, dTALE polypeptides are designed and used for targeting gene regulatory activity, such as transcriptional or translational modifier activity, to a regulatory, coding, and/or intergenic region, such as enhancer and/or repressor activity, that can affect transcription upstream and downstream of coding regions, and can be used to enhance or repress gene expression. For example, dTALE polypeptide can comprise effector domains having DNA-binding domains from transcription factors, effector domains from transcription factors (activators, repressors, co-activators, co-repressors), silencers, nuclear hormone receptors, and/or chromatin associated proteins and their modifiers (e.g., methylases, kinases, acetylases and deacetylases.

Molecules having gene regulatory activity from which one can obtain an effector domain for use in the dTALE polypeptides include those that are involved in regulated and basal transcription. Such polypeptides include transcription factors, their effector domains, coactivators, silencers, nuclear hormone receptors (see, e.g., Goodrich et al., Cell 84:825-30 (1996) for a review of proteins and nucleic acid elements involved in transcription; transcription factors in general are reviewed in Barnes and Adcock, Clin. Exp. Allergy 25 Suppl. 2:46-9 (1995) and Roeder, Methods Enzymol. 273:165-71 (1996)). Databases dedicated to transcription factors are also known (see, e.g., Science 269:630 (1995)). Nuclear hormone receptor transcription factors are described in, for example, Rosen et al., J. Med. Chem. 38:4855-74 (1995). The C/EBP family of transcription factors are reviewed in Wedel et al., Immunobiology 193:171-85 (1995). Coactivators and co-repressors that mediate transcription regulation by nuclear hormone receptors are reviewed in, for example, Meier, Eur. J. Endocrinol. 134(2): 158-9 (1996); Kaiser et al., Trends Biochem. Sci. 21:342-5 (1996); and Utley et al., Nature 394:498-502 (1998)). GATA transcription factors, which are involved in regulation of hematopoiesis, are described in, for example, Simon, Nat.

Genet. 11:9-11 (1995); Weiss et al., Exp. Hematol. 23:99-107. TATA box binding protein (T13P) and its associated TAF polypeptides (which include TAF30, TAF55, TAF80, TAF1 10, TAF150, and TAF250) are described in Goodrich & Tjian, Curr. Opin. Cell Biol. 6:403-9 (1994) and Hurley, Curr. Opin. Struct. Biol. 6:69-75 (1996). The STAT family of transcription factors are reviewed in, for example, Barahmand-Pour et al., Curr. Top. Microbiol. Immunol. 211:121-8 (1996). Transcription factors involved in disease are reviewed in Aso et al., J. Clin. Invest. 97:1561-9 (1996).

Kinases, phosphatases, and other proteins that modify or regulate other polypeptides involved in gene regulation are also useful as dTALE effector domains. Such modifiers are often involved in switching on or off transcription mediated by, for example, hormones. Kinases involved in transcription regulation are reviewed in Davis, Mol. Reprod. Dev. 42:459-67 (1995), Jackson et al., Adv. Second Messenger Phosphoprotein Res. 28:279-86 (1993), and Boulikas, Crit. Rev. Eukaryot. Gene Expr. 5:1-77 (1995), while phosphatases are reviewed in, for example, Schonthal & Semin, Cancer Biol. 6:239-48 (1995). Nuclear tyrosine kinases are described in Wang, Trends Biochem. Sci. 19:373-6 (1994).

As described herein, useful domains for regulatin gene expression can also be obtained from the gene products of oncogenes (e.g., myc, jun, fos, myb, max, mad, rel, ets, bcl, myb, mos family members) and their associated factors and modifiers. Oncogenes are described in, for example, Cooper, Oncogenes, 2nd ed., The Jones and Bartlett Series in Biology, Boston, Mass., Jones and Bartlett Publishers, 1995. The ets transcription factors are reviewed in Waslylk et al., Eur. J. Biochem. 211:7-18 (1993). Myc oncogenes are reviewed in, for example, Ryan et al., Biochem. J. 314:713-21 (1996). The Jun and fos transcription factors are described in, for example, The Fos and Jun Families of Transcription Factors, Angel & Herrlich, eds. (1994). The max oncogene is reviewed in Hurlin et al., Cold Spring Harb. Symp. Quant. Biol. 59:109-16. The myb gene family is reviewed in Kanei-Ishii et al., Curr. Top. Microbiol. Immunol. 211:89-98 (1996). The mos family is reviewed in Yew et al., Curr. Opin. Genet. Dev. 3:19-25 (1993).

In other embodiments of the aspescts described herein, histone acetyltransferases or derivative or analogs thereof having histone acetyltransferase activity can be used as transcriptional activator domains in the dTALE polypeptides described herein (see, e.g., Jin & Scotto, Mol. Cell. Biol. 18:4377-4384 (1998); Wolffle, Science 272:371-372 (1996); Taunton et al., Science 272:408-411 (1996); and Hassig et al., Proc. Natl. Acad. Sci. U.S.A. 95:3519-3524 (1998)). In some embodiments of the aspects described herein, histone deacetylases or derivative or analogs thereof having histone deacetylase activity are used as transcriptional repressors domains in the dTALE polypeptides described herein (see, e.g., Jin & Scotto, Mol. Cell. Biol. 18:4377-4384 (1998); Syntichaki & Thireos, J. Biol. Chem. 273:24414-24419 (1998); Sakaguchi et al., Genes Dev. 12:2831-2841 (1998); and Martinez et al., J. Biol. Chem. 273:23781-23785 (1998)).

Accordingly, in some embodiments of the aspects described herein, a dTALE having a transcription activator effector domain can be used to directly increase gene expression. In other embodiments of the aspects described herein, a dTALE comprising a transcriptional protein recruiting domain, or active fragment thereof, can be used to recruit transcriptional activators or repressors to a specific nucleic acid sequence, i.e., the sequence to which the dTALE polypeptide specifically bindsm, to thereby localize activators and repressors to modulate gene expression in a targeted manner.

In other embodiments of the aspects described herein, dTALE polypeptides comprising effector domains can similarly be used to target enzymatic activity to locations containing the target nucleic acid sequence to which the dTALE polypeptide specifically binds. For example, in some embodiments, effector domains having integrase or transposase activity can be used to promote integration of exogenous nucleic acid sequence into specific nucleic acid sequence regions, eliminate (knock-out) specific endogenous nucleic acid sequence, and/or modify epigenetic signals and consequent gene regulation, such as by promoting DNA methyltransferase, DNA demethylase, histone acetylase and histone deacetylase activity. Similarly, in some embodiments, effector domains having nuclease activity can be used to alter genome structure by nicking or digesting target sequences to which dTALE polypeptides specifically bind, and can allow introduction of exogenous genes at those sites. In some embodiments, effector domains having invertase activity can be used to alter genome structure by swapping the orientation of a DNA fragment. In some embodiments, effector domains having resolvase activity can alter the genomic structure by changing the linking state of the DNA, e.g., by releasing concatemers. In some embodiments, effector domains having deaminase activity can be used to remove amino group(s) from a molecule.

Non-limiting examples of nucleic acid and protein sequences useful as effector domains for the dTALE polypeptides described herein are well known in the art and include, for example: transposase: Tc1 transposase, Mos1 transposase, Tn5 transposase, Mu transposase; integrase: HIV integrase, lambda integrase; recombinase: Cre recombinase, Flp recombinase, Hin recombinase; DNA methyltransferase: SssI methylase, AluI methylase, HaeIII methylase, HhaI methylase, HpaII methylase, human Dnmt1 methyltransferase; DNA demethylase: MBD2B, a candidate demethylase; histone acetylase: human GCN5, CBP (CREB-binding protein); histone deacetylase: HDAC1; nuclease: micrococcal nuclease, staphylococcal nuclease, DNase I, T7 endonuclease; resolvase: Ruv C resolvase, Holiday junction resolvase Hjc; and invertase: Hin invertase.

In other embodiments of the dTALE polypeptides described herein, a nuclear localization signal and/or cellular uptake signal can be used as an effector domain of a dTALE polypeptide to target a dTALE to the nucleus and/or intracellular compartments of a host cell. Such cellular uptake signals include, but are not limited to, the minimal Tat protein transduction domain or residues 47-57 of the human immunodeficiency virus Tat protein: YGRKKRRQRRR (SEQ ID NO: 3).

In some embodiments of the dTALE polypeptides described herein, the effector domain can have a nucleic acid binding activity distinct from the activity mediated by the nucleic acid binding domain of the dTALE polypeptide. For example, the effector domain can comprise another nucleic acid binding domain, such as those found in bacterial helix-turn-helix motif proteins, such as lambda repressor, tet repressor and winged helix proteins; Gal4; TATA binding protein; helix-loop-helix motif proteins, such as myc and myo D; leucine zipper type proteins, like fos and jun; beta sheet motif proteins, like met, arc, and mnt repressors; zinc finger proteins; homeodomain proteins, such as POU eukaryotic transcription factor proteins, forkhead proteins, HMG box proteins, methyl-CpG-binding proteins, etc. Exemplary methods and compositions using zinc finger nucleases can be found, for example, at US Patent Publication 20110158957, the contents of which are herein incorporated by reference in their entireties.

In other embodiments of the dTALE polypeptides described herein, the effector domain can comprise a peptide or polypeptide sequence responsive to a ligand, such as a hormone receptor ligand binding domain, including, for example, the ligand binding domains of the estrogen receptor, the ecydysone receptor system, the glucocorticosteroid receptor, and the like. Such effector domains can be used to act as "gene switches," and be regulated by inducers, such as small molecule or protein ligands, specific for the ligand binding domain.

In some embodiments of the dTALE polypeptides described herein, the effector domain can comprise sequences or domains of polypeptides that mediate direct or indirect protein-protein interactions, such as, for example, a leucine zipper domain, a STAT protein N terminal domain, and/or an FK506 binding protein (see, e.g., O'Shea, Science 254: 539 (1991), Barahmand-Pour et al., Curr. Top. Microbiol. Immunol. 211:121-128 (1996); Klemm et al., Annu. Rev. Immunol. 16:569-592 (1998); Klemm et al., Annu. Rev. Immunol. 16:569-592 (1998); Ho et al., Nature 382: 822-826 (1996); and Pomeranz et al., Biochem. 37:965 (1998)).

A dTALE polypeptide comprising an effector domain or a dTALE chimeric or fusion protein can be produced by standard recombinant DNA techniques, using, for example, embodiments of the mthods described herein. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a nuclear localization signal, effector domain, etc.). A dTALE-encoding nucleic acid can be cloned into such an expression vector such that the fusion moiety is linked in-frame to the dTALE protein.

The effector domains described herein are illustrative and merely provide the skilled artisan with examples of effectors that can be used in combination with nucleic acid binding domains of the dTALE polypeptides described herein.

Recombinant Expression Vectors and Host Cells for Expressing dTALE Polypeptides

Nucleic acid molecules encoding the dTALE polypeptides or components thereof described herein can, in some aspects, be inserted or incorporated into one or more vectors or plasmids as compositions for propagation, and/or for cloning purposes, and/or for introduction into cellular or non-cellular systems.

As used herein, the term "vector" is used interchangeably with "plasmid" to refer to a nucleic acid molecule capable of transporting another nucleic acid to which it has been linked A vector can have one or more restriction endonuclease recognition sites (whether type I, II or IIs) at which the sequences can be cut in a determinable fashion without loss of an essential biological function of the vector, and into which a nucleic acid fragment can be spliced or inserted in order to bring about its replication and cloning. Vectors can also comprise one or more recombination sites that permit exchange of nucleic acid sequences between two nucleic acid molecules. Vectors can further provide primer sites, e.g., for PCR, transcriptional and/or translational initiation and/or regulation sites, recombinational signals, replicons, selectable markers, etc. A vector can further contain one or more selectable markers suitable for use in the identification of cells transformed with the vector.

Vectors known in the art and those commercially available (and variants or derivatives thereof) can be used with the compositions comprising nucleic acids encoding dTALE polypeptides and methods of generating dTALE polypeptides described herein. Such vectors can be obtained from, for example, Vector Laboratories Inc., Invitrogen, Promega, Novagen, NEB, Clontech, Boehringer Mannheim, Pharmacia, EpiCenter, OriGenes Technologies Inc., Stratagene, PerkinElmer, Pharmingen, and Research Genetics. General classes of vectors include prokaryotic and/or eukaryotic cloning vectors, expression vectors, fusion vectors, two-hybrid or reverse two-hybrid vectors, shuttle vectors for use in different hosts, mutagenesis vectors, transcription vectors, vectors for receiving large inserts, and the like.

Vectors capable of directing the expression of genes and/or nucleic acid sequence to which they are operatively linked, in an appropriate host cell (e.g., a prokaryotic cell, eukaryotic cell, or mammalian cell), are referred to herein as "expression vectors." If translation of the desired nucleic acid sequence is required, such as for example, the mRNA encoding a dTALE polypeptide, the vector also typically comprises sequences required for proper translation of the nucleotide sequence. The term "expression," as used herein, refers to the biosynthesis of a nucleic acid sequence product, i.e., to the transcription and/or translation of a nucleotide sequence, for example, a nucleic acid sequence encoding a dTALE polypeptide in a cell. Expression also refers to biosynthesis of a microRNA or RNAi molecule, which refers to expression and transcription of an RNAi agent such as siRNA, shRNA, and antisense DNA, that do not require translation to polypeptide sequences.

In general, expression vectors of utility in the methods of generating and compositions comprising dTALE polypeptides described herein are often in the form of "plasmids," which refer to circular double stranded DNA loops which, in their vector form, are not bound to a chromosome. In some embodiments of the aspects described herein, all components of a given dTALE polypeptide can be encoded in a single vector. For example, in some embodiments, a vector can be constructed that contains or comprises all components necessary for a functional dTALE polypeptide as described herein. In some embodiments, individual components (e.g., one or more monomer units and one or more effector domains) can be separately encoded in different vectors and introduced into one or more cells separately. Moreover, any vector described herein can itself comprise predetermined dTALE polypeptide encoding component sequences, such as an effector domain and/or dTALE monomer unit, at any location or combination of locations, such as 5' to, 3' to, or both 5' and 3' to the exogenous nucleic acid molecule comprising one or more component dTALE encoding sequences to be cloned in. Such expression vectors are termed herein as comprising "backbone sequences." Exemplary vector backbone sequences useful, in some embodiments, for cloning and expression of dTALE polypeptides described herein include, but are not limited to, SEQ ID NOs: 192-195.

Different expression vectors can be used in different embodiments described herein, for example, but not limited to, plasmids, episomes, bacteriophages, or viral vectors, and such vectors can integrate into a host cell's genome or replicate autonomously in the particular cellular system used. In some embodiments of the compositions and methods described herein, the vector used is an episomal vector, i.e., a nucleic acid capable of extra-chromosomal replication. Such plasmids or vectors can include plasmid sequences from bacteria, viruses or phages. Such vectors include chromosomal, episomal and virus-derived vectors e.g., vectors derived from bacterial plasmids, bacteriophages, yeast episomes, yeast chromosomal elements, and viruses, vectors derived from combinations thereof, such as those derived from plasmid and bacteriophage genetic elements, cosmids and phagemids. In some embodiments, a vector can be a plasmid, bacteriophage, bacterial artificial chromosome (BAC) or yeast artificial chromosome (YAC). A vector can be a single or double-stranded DNA, RNA, or phage vector.

Viral vectors include, but are not limited to, retroviral vectors, such as lentiviral vectors or gammaretroviral vectors, adenoviral vectors, and baculoviral vectors. For example, a lentiviral vector can be used in the form of lentiviral particles. Other forms of expression vectors known by those skilled in the art which serve equivalent functions can also be used. Expression vectors can be used for stable or transient expression of the polypeptide encoded by the nucleic acid sequence being expressed. A vector can be a self replicating extrachromosomal vector or a vector which integrates into a host genome. One type of vector is a genomic integrated vector, or "integrated vector", which can become integrated into the chromosomal DNA or RNA of a host cell, cellular system, or non-cellular system. In some embodiments, the nucleic acid sequence encoding the dTALE polypeptides or component sequences, such as an effector domain sequence and/or dTALE monomer unit sequence, described herein, integrates into the chromosomal DNA or RNA of a host cell, cellular system, or non-cellular system along with components of the vector sequence.

The recombinant expression vectors used herein comprise a dTALE nucleic acid in a form suitable for expression of the nucleic acid in a host cell, which indicates that the recombinant expression vector(s) include one or more regulatory sequences, selected on the basis of the host cell(s) to be used for expression, which is operatively linked to the nucleic acid sequence to be expressed. Within a recombinant expression vector, the terms "operable linkage" or "operably linked" are used interchangeably herein, and are intended to mean that the nucleotide sequence of interest is linked to one or more regulatory sequence(s) in a manner which allows for expression of the nucleotide sequence (e.g., in an in vitro transcription/translation system or in a host cell when the vector is introduced into the host cell) and in such a way that each of the regulatory elements can fulfill its intended function to allow, modify, facilitate, or otherwise influence expression of the linked nucleic acid sequence.

As used herein, the term "regulatory sequence" is intended to include promoters, enhancers and other expression control elements (e.g., 5' and 3' untranslated regions (UTRs) and polyadenylation signals). Such regulatory sequences are described, for example, in Goeddel; *Gene Expression Technology: Methods in Enzymology* 185, Academic Press, San Diego, Calif. (1990). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors can be introduced into host cells to thereby produce proteins or peptides, including fusion proteins or peptides, encoded by nucleic acids as described herein (e.g., dTALE polypeptides, variant forms of dTALE polypeptides, dTALE fusion proteins, etc.).

The terms "promoter," "promoter element," or "promoter sequence" are equivalents and as used herein, refers to a DNA sequence which when operatively linked to a nucleotide sequence of interest is capable of controlling the transcription of the nucleotide sequence of interest into mRNA. A promoter is typically, though not necessarily, located 5' (i.e., upstream) of a nucleotide sequence of interest (e.g., proximal to the transcriptional start site of a structural gene) whose transcription into mRNA it controls, and provides a site for specific binding by RNA polymerase and other transcription factors for initiation of transcription. A polynucleotide sequence is "heterologous to" an organism or a second polynucleotide sequence if it originates from a foreign species, or, if from the same species, is modified from its original form. For example, a promoter operably linked to a heterologous coding sequence refers to a coding sequence from a species different from that from which the promoter was derived, or, if from the same species, a coding sequence which is not naturally associated with the promoter (e.g. a genetically engineered coding sequence or an allele from a different ecotype or variety). Suitable promoters can be derived from genes of the host cells where expression should occur or from pathogens for the host cells (e.g., tissue promoters or pathogens like viruses).

If a promoter is an "inducible promoter", as defined herein, then the rate of transcription is modified in response to an inducing agent or inducer. In contrast, the rate of transcription is not regulated by an inducer if the promoter is a constitutive promoter. The term "constitutive" when made in reference to a promoter means that the promoter is capable of directing transcription of an operably linked nucleic acid sequence in the absence of a stimulus (e.g., heat shock, chemicals, agents, light, etc.). Typically, constitutive promoters are capable of directing expression of a nucleic acid sequence in substantially any cell and any tissue. In contrast, the term "regulateable" or "inducible" promoter referred to herein is one which is capable of directing a level of transcription of an operably linked nucleic acid sequence in the presence of a stimulus (e.g., heat shock, chemicals, light, agent etc.) which is different from the level of transcription of the operably linked nucleic acid sequence in the absence of the stimulus.

A promoter for use with the expression vectors comprising nucleic acid sequences encoding dTALE polypeptides described herein can be regulated in a tissue-specific or tissue preferred manner such that it is only active in transcribing the associated coding region in a specific tissue type(s). The term "tissue specific" as it applies to a promoter refers to a promoter that is capable of directing selective expression of a nucleotide sequence of interest to a specific type of tissue (e.g., liver) in the relative absence of expression of the same nucleotide sequence of interest in a different type of tissue (e.g., kidney). Tissue specificity of a promoter can be evaluated by, for example, operably linking a reporter gene to the promoter sequence to generate a reporter construct, introducing the reporter construct into the genome of an organism, e.g. an animal model such that the reporter construct is integrated into every tissue of the resulting transgenic animal, and detecting the expression of the reporter gene (e.g., detecting mRNA, protein, or the activity of a protein encoded by the reporter gene) in different tissues of the transgenic animal. The detection of a greater level of expression of the reporter gene in one or more tissues relative to the level of expression of the reporter gene in other tissues shows that the promoter is specific for the tissues in which greater levels of expression are detected. The term "cell type specific" as applied to a promoter refers to a promoter, which is capable of directing selective expression of a nucleotide sequence of interest in a specific type of cell in the relative absence of expression of the same nucleotide sequence of interest in a different type of cell within the same tissue. The term "cell type specific" when applied to a promoter also means a promoter capable of promoting selective expression of a nucleotide sequence of interest in a region within a single tissue. Cell type specificity of a promoter can be assessed using methods well known in the art, e.g., GUS activity staining or immunohistochemical staining. The term "minimal promoter" as used herein refers to the minimal nucleic acid sequence comprising a promoter element while also maintaining a functional promoter. A minimal promoter can comprise an inducible, constitutive or tissue-specific promoter.

As used herein, the term "enhancer" refers to a cis-acting regulatory sequence involved in the transcriptional activation of a nucleic acid sequence. An enhancer can function in either orientation and can be upstream or downstream of the promoter.

Untranslated regions or UTRs refer to sections of an mRNA sequence prior to the start codon and after the stop codon, termed the five prime untranslated region (5' UTR) and three prime untranslated region (3' UTR), respectively, that are not translated, but that are transcribed as part of an mRNA sequence. Several roles in gene expression have been attributed to the untranslated regions, including mRNA stability, mRNA localization, and translational efficiency. The ability of a UTR to perform these functions depends on the sequence of the UTR and can differ between mRNAs. These UTR regions are transcribed with the coding region and thus are exonic as they are present in the mature mRNA. The stability of mRNAs can be controlled by the 5' UTR and/or 3' UTR due to varying affinity for RNA degrading enzymes or "ribonucleases" and for ancillary proteins that can promote or inhibit RNA degradation. Translational efficiency, including sometimes the complete inhibition of translation, can be controlled by UTRs. Proteins that bind to either the 3' or 5' UTR can affect translation by influencing the ribosome's ability to bind to the mRNA. MicroRNAs bound to the 3' UTR also can also affect translational efficiency or mRNA stability. Some of the elements contained in untranslated regions form a characteristic secondary structure when transcribed into RNA. These structural mRNA elements are involved in regulating the mRNA. Some, such as the SECIS element, are targets for proteins to bind. One class of mRNA element, the riboswitches, directly bind small molecules, changing their fold to modify levels of transcription or translation.

In some embodiments, the recombinant expression vectors comprising a nucleic acid encoding a dTALE polypeptide described herein further comprise a 5'UTR sequence and/or a 3' UTR sequence, thereby providing the nucleic acid sequence transcribed from the expression vector additional stability and translational efficiency.

As used herein, the terms "five prime untranslated region" or "5' UTR" refer to the sequence of an mRNA molecule that begins at the transcription start site and ends one nucleotide (nt) before the start codon (usually AUG) of the coding region of an RNA. A 5' UTR can comprise genetic elements or sequence for controlling gene expression by way of regulatory elements. In prokaryotes, the 5' UTR usually contains a ribosome binding site (RBS), also known as the Shine Dalgarno sequence. Regulatory sequences that can be found in a 5' UTR include, for example, binding sites for proteins, which can affect the mRNA's stability or translation; riboswitches; and sequences that promote or inhibit translation initiation.

As used herein, the terms "three prime untranslated region" or "3' UTR" refer to the sequence of an mRNA molecule that begins following, but not necessarily immediately after, the stop codon of the coding region of an open reading frame sequence. Cytoplasmic localization of mRNA is believed to be a function of the 3' UTR. In the case of proteins that undergo translation at a particular location in a cell where they are needed, the 3' UTR can contain sequences that allow the transcript to be localized to this region for translation. Regulatory sequences typically found in the 3' UTR include, for example: (i) a polyadenylation signal, or a slight variant thereof. This marks the site of cleavage of the transcript approximately 30 base pairs past the signal, followed by the several hundred adenine residue (poly-A tail); (ii) binding sites for proteins, that can affect the mRNA's stability or location in the cell, like SECIS elements (which direct the ribosome to translate the codon UGA as selenocysteines rather than as a stop codon), or AU-rich elements (AREs), stretches consisting of mainly adenine and uracil nucleotides (which can either stabilize or destabilize the mRNA depending on the protein bound to it), (iii) binding sites for miRNAs, and/or (iv) microRNA seed sequences.

Recombinant expression vectors for use in the compositions and methods described herein can be designed for expression of dTALE in prokaryotic or eukaryotic cells. For example, dTALE can be expressed in bacterial cells such as *E. coli*, insect cells (using baculovirus expression vectors), yeast cells, and/or mammalian cells, as described herein. Suitable host cells are discussed further herein as well as in Goeddel, *Gene Expression Technology: Methods in Enzymology* 185, Academic Press, San Diego, Calif. (1990). Alternatively, the recombinant expression vector can be transcribed and translated in vitro, for example, using T7 promoter regulatory sequences and T7 polymerase for synthesis using in vitro transcription and translation methods known to one of ordinary skill in the art.

In some embodiments of the aspects described herein, a dTALE polypeptide is expressed in a prokaryotic cell. Expression of dTALE polypeptides in prokaryotes is typically carried out in, for example, *E. coli*, with expression vectors containing constitutive or inducible promoters directing the expression of the nucleic acid sequence encoding the dTALE polypeptide(s). In some such embodiments, fusion vectors are used, which add a number of amino acids to the dTALE polypeptide encoded therein, usually to the amino terminus of the dTALE polypeptide. Such fusion vectors typically serve any of three purposes: 1) to increase expression of the dTALE polypeptide; 2) to increase the solubility of the dTALE polypeptide; and/or 3) to aid in the purification of the dTALE polypeptide by acting as a ligand in affinity purification. In some embodiments using fusion expression vectors, a proteolytic cleavage site is introduced at the junction of the fusion moiety and the dTALE polypeptide to enable separation of the dTALE polypeptide from the fusion moiety subsequent to purification of the dTALE polypeptide. Such enzymes, and their cognate recognition sequences, include Factor Xa, thrombin and enterokinase. Typical fusion expression vectors include pGEX (Pharmacia Biotech Inc; Smith, D. B. and Johnson, K. S. (1988) *Gene* 67:31-40), pMAL (New England Biolabs, Beverly, Mass.) and pRIT5 (Pharmacia, Piscataway, N.J.) which are used to fuse glutathione S-transferase (GST), maltose E binding protein, or protein A, respectively, to the target dTALE polypeptide. For example, the sequence encoding the dTALE polypeptide is cloned into a pGEX expression vector to create a vector encoding a fusion protein having, from the N-terminus to the C-terminus: GST-thrombin cleavage site-dTALE polypeptide. The fusion protein can be purified by affinity chromatography using glutathione-agarose resin. Recombinant dTALE polypeptide unfused to GST can then be recovered by cleavage of the fusion protein with thrombin.

In some embodiments of the aspects described herein, a dTALE polypeptide is expressed in a prokaryotic cell using an inducible non-fusion *E. coli* expression vector. Examples of suitable inducible non-fusion *E. coli* expression vectors include pTrc (Amann et al., (1988) Gene 69:301-315) and pET 11d (Studier et al., *Gene Expression Technology: Methods in Enzymology* 185, Academic Press, San Diego, Calif. (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174(DE3) from a resident λ prophage harboring a T7 gn1 gene under the transcriptional control of the lacUV 5 promoter.

One strategy to maximize recombinant protein expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119-128). Another strategy is to alter the nucleic acid sequence of the nucleic acid to be inserted into an expression vector so that the individual codons for each amino acid are those utilized in *E. coli* (Wada et al. (1992) *Nucleic Acids Res.* 20:2111-2118). Such alteration of dTALE nucleic acid sequences can be carried out by standard DNA synthesis techniques.

Exemplary prokaryotic vectors include, but are not limited to, pZErO1.1, pZErO-2.1, pcDNA II, pSL301, pSE280, pSE380, pSE420, pTrcHisA, B, and C, pRSET A, B, and C (Invitrogen, Corp.), pGEMEX-1, and pGEMEX-2 (Promega, Inc.), the pET vectors (Novagen, Inc.), pTrc99A, pKK223-3, the pGEX vectors, pEZZ18, pRIT2T, and pMC1871 (Pharmacia, Inc.), pKK233-2 and pKK388-1 (Clontech, Inc.), and pProEx-HT (Invitrogen, Corp.) and variants and derivatives thereof. Other vectors of interest include eukaryotic expression vectors such as pFastBac, pFastBacHT, pFastBacDUAL, pSFV, and pTet-Splice (Invitrogen), pEUK-C1, pPUR, pMAM, pMAMneo, pBI101, pBI121, pDR2, pCMVEBNA, and pYACneo (Clontech), pSVK3, pSVL, pMSG, pCH110, and pKK232-8 (Pharmacia, Inc.), p3'SS, pXT1, pSG5, pPbac, pMbac, pMC1 neo, and pOG44 (Stratagene, Inc.), and pYES2, pAC360, pBlueBacHis A, B, and C, pVL1392, pBlueBacIII, pCDM8, pcDNA1, pZeoSV, pcDNA3 pREP4, pCEP4, and pEBVHis (Invitrogen, Corp.), pTrxFus, pThioHis, pLEX, pTrcHis, pTrcHis2, pRSET, pBlueBacHis2, pcDNA3.1/His, pcDNA3.1(−)/Myc-His, pSecTag, pEBVHis, pPIC9K, pPIC3.5K, pAO815, pPICZ, pPICZ.alpha., pGAPZ, pGAPZ.alpha., pBlueBac4.5, pBlueBacHis2, pMelBac, pSinRep5, pSinHis, pIND, pIND(SP1), pVgRXR, pcDNA2.1, pYES2, pCR-Blunt, pSE280, pSE380, pSE420, pVL1392, pVL1393, pCDM8, pcDNA1.1, pcDNA1.1/Amp, pcDNA3.1, pcDNA3.1/Zeo, pSe, SV2, pRc/CMV2, pRc/RSV, pREP4, pREP7, pREP8, pREP9, pREP 10, pCEP4, pEBVHis, pCR3.1, pCR2.1, pCR3.1-Uni, and pCRBac from Invitrogen; .lamda. ExCell, .lamda. gt11, pTrc99A, pKK223-3, pGEX-1.lamda.T, pGEX-2T, pGEX-2TK, pGEX-4T-1, pGEX-4T-2, pGEX-4T-3, pGEX-3X, pGEX-5X-1, pGEX-5X-2, pGEX-5X-3, pEZZ18, pRIT2T, pMC1871, pSVK3, pSVL, pMSG, pCH110, pKK232-8, pSL1180, pNEO, and pUC4K from Pharmacia; pSCREEN-1b(+), pT7Blue(R), pT7Blue-2, pCITE-4-abc(+), pOCUS-2, pTAg, pET-32LIC, pET-30LIC, pBAC-2 cp LIC, pBACgus-2cp LIC, pT7Blue-2 LIC, pT7Blue-2, .lamda.SCREEN-1, .lamda.BlueSTAR, pET-3abcd, pET-7abc, pET9abcd, pET11abcd, pET12abc, pET-14b, pET-15b, pET-16b, pET-17b-pET-17xb, pET-19b, pET-20b(+), pET-21abcd(+), pET-22b(+), pET-23abcd(+), pET-24abcd(+), pET-25b(+), pET-26b(+), pET-27b(+), pET-28abc(+), pET-29abc(+), pET-30abc(+), pET-31 b(+), pET-32abc(+), pET-33b(+), pBAC-1, pBACgus-1, pBAC4x-1, pBACgus4x-1, pBAC-3cp, pBACgus-2cp, pBACsurf-1, plg, Signal plg, pYX, Selecta Vecta-Neo, Selecta Vecta-Hyg, and Selecta Vecta-Gpt from Novagen; pLexA, pB42AD, pGBT9, pAS2-1, pGAD424, pACT2, pGAD GL, pGAD GH, pGAD10, pGilda, pEZM3, pEGFP, pEGFP-1, pEGFP-N, pEGFP-C, pEBFP, pGFPuv, pGFP, p6xHis-GFP ("6xHis" disclosed as SEQ ID NO: 315), pSEAP2-Basic, pSEAP2-Contral, pSEAP2-Promoter, pSEAP2-Enhancer, pβgal-Basic, pβgal-Control, pβgal-Promoter, pβgal-Enhancer, pCMVβ, pTet-Off, pTet-On, pTK-Hyg, pRetro-Off, pRetro-On, pIRES1neo, pIRES1hyg, pLXSN, pLNCX, pLAPSN, pMAMneo, pMAMneo-CAT, pMAMneo-LUC, pPUR, pSV2neo, pYEX4T-1/2/3, pYEX-S1, pBacPAK-His, pBacPAK8/9, pAcUW31, BacPAK6, pTrip1Ex, λgt10, λgt11, pWE15, and λTrip1Ex from Clontech; Lambda ZAP II, pBK-CMV, pBK-RSV, pBluescript II KS+/−, pBluescript II SK+/−, pAD-GAL4, pBD-GAL4 Cam, pSurfscript, Lambda FIX II, Lambda DASH, Lambda EMBL3, Lambda EMBL4, SuperCos, pCR-Scrigt Amp, pCR-Script Cam, pCR-Script Direct, pBS+/−, pBC KS+/−, pBC SK+/−, Phagescript, pCAL-n-EK, pCAL-n, pCAL-c, pCAL-kc, pET-3abcd, pET-11abcd, pSPUTK, pESP-1, pCMVLacl, pOPRSVI/MCS, pOPI3 CAT, pXT1, pSG5, pPbac, pMbac, pMC1 neo, pMC1neo Poly A, pOG44, pOG45, pFRTβGAL, pNEOβGAL, pRS403, pRS404, pRS405, pRS406, pRS413, pRS414, pRS415, and pRS416 from Stratagene, and variants or derivatives thereof.

In some embodiments of the aspects described herein, a dTALE polypeptide is expressed using a viral vector, in which additional DNA segments can be ligated into the viral genome, (e.g., replication defective retroviruses, adenoviruses and adeno-associated viruses). Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an *orthopox*, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The vectors can further include viral sequences for transfection, if desired. Alternatively, the nucleic acid sequence encoding dTALE polypeptide can be incorporated into vectors capable of episomal replication, e.g, EPV and EBV vectors.

In some embodiments of the aspects described herein, a dTALE polypeptide is expressed using a yeast expression vector. Examples of vectors for expression in yeast *S. cerivisae* include, but are not limited to, pYepSec1 (Baldari, et al., (1987) *EMBO J.* 6:229-234), pMFa (Kurjan and Herskowitz, (1982) *Cell* 30:933-943), pJRY88 (Schultz et al., (1987) *Gene* 54:113-123), and pYES2 (Invitrogen Corporation, San Diego, Calif.).

In some embodiments of the aspects described herein, a dTALE polypeptide is expressed in insect cells using, for example, baculovirus expression vectors. Baculovirus vectors available for expression of proteins in cultured insect cells (e.g., Sf 9 cells) include, but are not limited to, the pAc series (Smith et al. (1983) *Mol. Cell. Biol.* 3:2156-2165) and the pVL series (Lucklow and Summers (1989) *Virology* 170:31-39).

In some embodiments of the aspects described herein, a dTALE polypeptide is expressed in mammalian cells using a mammalian expression vector. Non-limiting examples of mammalian expression vectors include pCDM8 (Seed, B. (1987) *Nature* 329:840) and pMT2PC (Kaufman et al. (1987) *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40.

In some such embodiments, the mammalian expression vector is capable of directing expression of the nucleic acid encoding the dTALE polypeptide in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J.* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *Proc. Natl. Acad. Sci. USA* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264,166). Developmentally-regulated promoters are also encompassed, for example, the murine hox promoters (Kessel and Gruss (1990) *Science* 249:374-379) and the α-fetoprotein promoter (Campes and Tilghman (1989) *Genes Dev.* 3:537-546).

The vectors comprising nucleic acid sequences encoding the dTALE polypeptides described herein can be "introduced" into cells as polynucleotides, preferably DNA, by techniques well-known in the art for introducing DNA and RNA into cells. The term "transduction" refers to any method whereby a nucleic acid sequence is introduced into a cell, e.g., by transfection, lipofection, electroporation (methods whereby an instrument is used to create micro-sized holes transiently in the plasma membrane of cells under an electric discharge, see, e.g., Banerjee et al., Med. Chem. 42:4292-99 (1999); Godbey et al., Gene Ther. 6:1380-88 (1999); Kichler et al., Gene Ther. 5:855-60 (1998); Birchaa et al., J. Pharm. 183:195-207 (1999)), biolistics, passive uptake, lipid:nucleic acid complexes, viral vector transduction, injection, contacting with naked DNA, gene gun (whereby the nucleic acid is coupled to a nanoparticle of an inert solid (commonly gold) which is then "shot" directly into the target cell's nucleus), calcium phosphate, DEAE dextran, lipofectin, lipofectamine, DIMRIE C™, Superfect™, and Effectin™ (Qiagen™) unifectin™, maxifectin™, DOTMA, DOGS™ (Transfectam; dioctadecylamidoglycylspermine), DOPE (1,2-dioleoyl-sn-glycero-3-phosphoethanolamine), DOTAP (1,2-dioleoyl-3-trimethylammonium propane), DDAB (dimethyl dioctadecylammonium bromide), DHDEAB (N,N-di-n-hexadecyl-N,N-dihydroxyethyl ammonium bromide), HDEAB (N-n-hexadecyl-N,N-dihydroxyethylammonium bromide), polybrene, poly(ethylenimine) (PEI), sono-poration (transfection via the application of sonic forces to cells), optical transfection (methods whereby a tiny (~1 μm diameter) hole is transiently generated in the plasma membrane of a cell using a highly focused laser), magnetofection (refers to a transfection method, that uses magnetic force to deliver exogenous nucleic acids coupled to magnetic nanoparticles into target cells), impalefection (carried out by impaling cells by elongated nanostructures, such as carbon nanofibers or silicon nanowires which have been coupled to exogenous nucleic acids), and the like.

The vectors, in the case of phage and viral vectors can also be introduced into cells as packaged or encapsidated virus by well-known techniques for infection and transduction. Viral vectors can be replication competent or replication defective. In the latter case, viral propagation generally occurs only in complementing host cells. In some embodiments, the nucleic acid sequences encoding the dTALE polypeptides are introduced into a cell using other mechanisms known to one of skill in the art, such as a liposome, microspheres, gene gun, fusion proteins, such as a fusion of an antibody moiety with a nucleic acid binding moiety, or other such delivery vehicle.

The nucleic acid sequences encoding the dTALE polypeptides or the vectors comprising the nucleic acid sequences encoding the dTALE polypeptides described herein can be introduced into a cell using any method known to one of skill in the art. The term "transformation" as used herein refers to the introduction of genetic material (e.g., a vector comprising a nucleic acid sequence encoding a dTALE polypeptide) into a cell, tissue or organism. Transformation of a cell can be stable or transient. The term "transient transformation" or "transiently transformed" refers to the introduction of one or more transgenes into a cell in the absence of integration of the transgene into the host cell's genome. Transient transformation can be detected by, for example, enzyme linked immunosorbent assay (ELISA), which detects the presence of a polypeptide encoded by one or more of the transgenes. For example, a nucleic acid sequence encoding a dTALE polypeptide can further comprise a constitutive promoter operably linked to a second output product, such as a reporter protein. Expression of that reporter protein indicates that a cell has been transformed or transfected with the nucleic acid sequence encoding a dTALE polypeptide. Alternatively, or in combination, transient transformation can be detected by detecting the activity of the dTALE polypeptide. The term "transient transformant" refers to a cell which has transiently incorporated one or more transgenes.

In contrast, the term "stable transformation" or "stably transformed" refers to the introduction and integration of one or more transgenes into the genome of a cell or cellular system, preferably resulting in chromosomal integration and stable heritability through meiosis. Stable transformation of a cell can be detected by Southern blot hybridization of genomic DNA of the cell with nucleic acid sequences, which are capable of binding to one or more of the transgenes. Alternatively, stable transformation of a cell can also be detected by the polymerase chain reaction of genomic DNA of the cell to amplify transgene sequences. The term "stable transformant" refers to a cell, which has stably integrated one or more transgenes into the genomic DNA. Thus, a stable transformant is distinguished from a transient transformant in that, whereas genomic DNA from the stable transformant contains one or more transgenes, genomic DNA from the transient transformant does not contain a transgene. Transformation also includes introduction of genetic material into plant cells in the form of plant viral vectors involving epichromosomal replication and gene expression, which can exhibit variable properties with respect to meiotic stability. Transformed cells, tissues, or plants are understood to encompass not only the end product of a transformation process, but also transgenic progeny thereof.

For stable transfection of mammalian cells, it is known that, depending upon the expression vector and transfection technique used, only a small fraction of cells may integrate the foreign DNA into their genome. In order to identify and select these integrants, a gene that encodes a selectable biomarker (e.g., resistance to antibiotics) is generally introduced into the host cells along with the gene of interest. Selectable markers include those which confer resistance to drugs, such as G418, hygromycin and methotrexate. Nucleic acid encoding a selectable biomarker can be introduced into a host cell on the same vector as that encoding dTALE or can be introduced on a separate vector. Cells stably transfected with the introduced nucleic acid can be identified by drug selection (e.g., cells that have incorporated the selectable biomarker gene will survive, while the other cells die).

A host cell, such as a prokaryotic or eukaryotic host cell in culture, can be used to produce (i.e., express) a dTALE polypeptide as described herein, or can be the cell in which the dTALE polypeptide is expressed to mediate its effect on a target gene sequence, as demonstrated herein (see, for example, Example 5 and FIGS. 7A-7C).

A host cell can be any cell, including non-plant, moneran, fungal, prokaryotic or eukaryotic cell. As defined herein, a "cell" or "cellular system" is the basic structural and functional unit of all known independently living organisms. It is the smallest unit of life that is classified as a living thing, and is often called the building block of life. Some organisms, such as most bacteria, are unicellular (consist of a single cell). Other organisms, such as humans, are multicellular. A "natural cell," as defined herein, refers to any prokaryotic or eukaryotic cell found naturally. A "prokaryotic cell" can comprise a cell envelope and a cytoplasmic region that contains the cell genome (DNA) and ribosomes and various sorts of inclusions. In other embodiments, the cell or cellular system is an artificial or synthetic cell. As defined herein, an "artificial cell" or a "synthetic cell" is a minimal cell formed from artificial parts that can do many things a natural cell can do, such as transcribe and translate proteins and generate ATP.

For example, a dTALE polypeptide can be expressed in bacterial cells, such as *E. coli*; insect cells, such as SF9 or SF-21 cells from *Spodoptera frugiperda* or S2 cells from *Drosophila melanogaster*; plant cells, such as a tobacco plant cell; yeast or fungal cells, such as a cell from *Pichia pastoris, Rhizopus, Aspergillus*, or *S. cerevisiae*; animal cells, such as nematode, insect, plant, bird, reptile, or mammalian cells (such as, for example, cells from a mouse, rat, rabbit, hamster, gerbil, dog, cat, goat, pig, cow, horse, whale, monkey, or human, e.g., 293FT cells, Fao hepatoma cells, primary hepatocytes, Chinese hamster ovary cells (CHO), or COS cells). The cells can be primary cells, immortalized cells, stem cells, or transformed cells. Other suitable host cells are known to those skilled in the art. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

In some embodiments of the aspects described herein, a primary somatic cell is used as the host cell for expression of a dTALE polypeptide and/or is the cell type in which the dTALE polypeptide is expressed to mediate its effect on a target gene sequence via its nucleic acid binding domain. Essentially any primary somatic cell type can be used as a host cell for expressing a dTALE polypeptide. Some non-limiting examples of primary cells include, but are not limited to, fibroblast, epithelial, endothelial, neuronal, adipose, cardiac, skeletal muscle, immune cells, hepatic, splenic, lung, circulating blood cells, gastrointestinal, renal, bone marrow, and pancreatic cells. The cell can be a primary cell isolated from any somatic tissue including, but not limited to, brain, liver, lung, gut, stomach, intestine, fat, muscle, uterus, skin, spleen, endocrine organ, bone, etc. The term "somatic cell," as used herein, further encompasses primary cells grown in culture, provided that the somatic cells are not immortalized.

Where the cell is maintained under in vitro conditions, conventional tissue culture conditions and methods can be used, and are known to those of skill in the art. Isolation and culture methods for various cells are well within the abilities of one skilled in the art.

Further, the parental cell can be from any mammalian species, with non-limiting examples including a murine, bovine, simian, porcine, equine, ovine, or human cell. In some embodiments, the cell is a human cell. In an alternate embodiment, the cell is from a non-human organism such as a non-human mammal.

As demonstrated herein, for example, at Example 5 and FIGS. 7A-7C, the dTALE polypeptides described herein can be used to activate transcription of known pluripotency factors, such as SOX2, KLF4, c-Myc, and Oct-4, in 293FT cells. Accordingly, in some embodiments of the aspects described herein, cells of a cell line are used as the host cell for expression of a dTALE polypeptide and/or are the cell type in which the dTALE polypeptide is expressed to mediate its effect on a target gene sequence via its nucleic acid binding domain. In some such embodiments, the host cell is a mammalian cell line. In some such embodiments, the mammalian cell line is a human cell line.

Examples of human cell lines useful with the compositions and methods provided herein include, but are not limited to, 293T (embryonic kidney), BT-549 (breast), DMS114 (small cell lung), DU145 (prostate), HT-1080 (fibrosarcoma), HEK 293 (embryonic kidney), HeLa (cervical carcinoma), HepG2 (hepatocellular carcinoma), HL-60 (TB) (leukemia), HS 578T (breast), HT-29 (colon adenocarcinoma), Jurkat (T lymphocyte), M14 (melanoma), MCF7 (mammary), MDA-MB-453 (mammary epithelial), PERC6® (E1-transformed embryonal retina), RXF 393 (renal), SF-268 (CNS), SF-295 (CNS), THP-1 (monocyte-derived macrophages), TK-10 (renal), U293 (kidney), UACC-257 (melanoma), and XF 498 (CNS).

Examples of non-human primate cell lines useful with the compositions and methods provided herein include, but are not limited to, monkey kidney (CV1-76) cells, African green monkey kidney (VERO-76) cells, green monkey fibroblast (Cos-1) cells, and monkey kidney (CV1) cells transformed by SV40 (Cos-7). Additional mammalian cell lines are known to those of ordinary skill in the art and are catalogued at the American Type Culture Collection catalog (ATCC®, Mamassas, Va.).

Examples of rodent cell lines useful with the compositions and methods provided herein include, but are not limited to, mouse Sertoli (TM4) cells, mouse mammary tumor (MMT) cells, rat hepatoma (HTC) cells, mouse myeloma (NSO) cells, murine hybridoma (Sp2/0) cells, mouse thymoma (EL4) cells, Chinese Hamster Ovary (CHO) cells and CHO cell derivatives, murine embryonic (NIH/3T3, 3T3 L1) cells, rat myocardial (H9c2) cells, mouse myoblast (C2C12) cells, and mouse kidney (miMCD-3) cells.

In some embodiments of the aspects described herein, a stem cell is used as the host cell for expression of a dTALE polypeptide and/or is the cell type in which the dTALE polypeptide is expressed to mediate its effect on a target gene sequence via its nucleic acid binding domain. As used herein, stem cells refer to undifferentiated cells defined by their ability at the single cell level to both self-renew and differentiate to produce progeny cells, including self-renewing progenitors, non-renewing progenitors, and terminally differentiated cells. Stem cells, depending on their level of differentiation, are also characterized by their ability to differentiate in vitro into functional cells of various cell lineages from multiple germ layers (endoderm, mesoderm and ectoderm), as well as to give rise to tissues of multiple germ layers following transplantation and to contribute substantially to most, if not all, tissues following injection into blastocysts. (See, e.g., Potten et al., Development 110: 1001 (1990); U.S. Pat. Nos. 5,750,376, 5,851,832, 5,753,506, 5,589,376, 5,824,489, 5,654,183, 5,693,482, 5,672,499, and 5,849,553, all herein incorporated in their entireties by reference). Stem cells that can be used in the compositions and methods comprising dTALE polypeptides and nucleic acid sequences encoding dTALE polypeptides described herein can be naturally occurring stem cells or "induced" stem cells generated using the compositions, kits, and methods described herein, or by any method or composition known to one of skill in the art.

Stem cells can be obtained from any mammalian species, e.g. human, primate, equine, bovine, porcine, canine, feline, rodent, e.g. mice, rats, hamster, etc. Stem cells are classified by their developmental potential as: (1) totipotent, meaning able to give rise to all embryonic and extraembryonic cell types; (2) pluripotent, meaning able to give rise to all embryonic cell types; (3) multipotent, meaning able to give rise to a subset of cell lineages, but all within a particular tissue, organ, or physiological system (for example, hematopoietic stem cells (HSC) can produce progeny that include HSC (self-renewal), blood cell restricted oligopotent progenitors and the cell types and elements (e.g., platelets) that are normal components of the blood); (4) oligopotent, meaning able to give rise to a more restricted subset of cell lineages than multipotent stem cells; and (5) unipotent, meaning able to give rise to a single cell lineage (e.g., spermatogenic stem cells). As demonstrated herein, for example, at Example 5 and FIGS. 7A-7C, dTALE polypeptides can be used to activate transcription of known pluripotency factors, such as SOX2, KLF4, c-Myc, and Oct-4.

Stem cells of interest for use with the dTALE polypeptides described herein include embryonic cells of various types, exemplified by human embryonic stem (hES) cells, described by Thomson et al. (1998) Science 282:1145; embryonic stem cells from other primates, such as Rhesus stem cells (Thomson et al. (1995) Proc. Natl. Acad. Sci. USA 92:7844); marmoset stem cells (Thomson et al. (1996) Biol. Reprod. 55:254); and human embryonic germ (hEG) cells (Shambloft et al., Proc. Natl. Acad. Sci. USA 95:13726, 1998). Also of interest are lineage committed stem cells, such as hematopoietic or pancreatic stem cells. In some embodiments, the host cell transfected with the expression vector comprising a sequence encoding a dTALE polypeptide is a multipotent stem cell or progenitor cell. Examples of multipotent cells useful in methods provided herein include, but are not limited to, murine embryonic stem (ES-D3) cells, human umbilical vein endothelial (HuVEC) cells, human umbilical artery smooth muscle (HuASMC) cells, human differentiated stem (HKB-I1) cells, and human mesenchymal stem (hMSC) cells. An additional stem cell type of interest for use with the compositions and methods described herein are cancer stem cells.

Cells derived from embryonic sources can include embryonic stem cells or stem cell lines obtained from a stem cell bank or other recognized depository institution. Other means of producing stem cell lines include the method of Chung et al (2006) which comprises taking a blastomere cell from an early stage embryo prior to formation of the blastocyst (at around the 8-cell stage). The technique corresponds to the pre-implantation genetic diagnosis technique routinely practiced in assisted reproduction clinics. The single blastomere cell is then co-cultured with established ES-cell lines and then separated from them to form fully competent ES cell lines.

Cells can also be derived from human umbilical cord blood cells (HUCBC), which are recognized as a rich source of hematopoietic and mesenchymal stem cells (Broxmeyer et al., 1992 Proc. Natl. Acad. Sci. USA 89:4109-4113). Cord blood cells are used as a source of transplantable stem and progenitor cells and as a source of marrow repopulating cells for the treatment of malignant diseases (e.g. acute lymphoid leukemia, acute myeloid leukemia, chronic myeloid leukemia, myelodysplastic syndrome, and nueroblastoma) and non-malignant diseases such as Fanconi's anemia and aplastic anemia (Kohli-Kumar et al., 1993 Br. J. Haematol. 85:419-422; Wagner et al., 1992 Blood 79; 1874-1881; Lu et al., 1996 Crit. Rev. Oncol. Hematol 22:61-78; Lu et al., 1995 Cell Transplantation 4:493-503). One advantage of HUCBC for use with the methods and compositions described herein is the immature immunity of these cells, which is very similar to fetal cells, and thus significantly reduces the risk for rejection by the host (Taylor & Bryson, 1985 J. Immunol. 134:1493-1497).

In other embodiments of the aspects described herein, cancer stem cells are used as the host cells for expression of a dTALE polypeptide described herein, in order to, for example, differentiate or alter the phenotype of a cancer stem cell to a non-tumorigenic state by activating one or more target gene sequences. Examples of tumors from which samples containing cancer stem cells can be isolated from or enriched, for use with the compositions and methods described herein, include sarcomas and carcinomas such as, but not limited to: fibrosarcoma, myxosarcoma, liposarcoma, chondrosarcoma, osteogenic sarcoma, chordoma, angiosarcoma, endotheliosarcoma, lymphangiosarcoma, mesothelioma, Ewing's tumor, lymphangioendotheliosarcoma, synovioma, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms' tumor, cervical cancer, testicular tumor, lung carcinoma, small cell lung carcinoma, bladder carcinoma, epithelial carcinoma, astrocytic tumors (e.g., diffuse, infiltrating gliomas, anaplastic astrocytoma, glioblastoma, gliosarcoma, pilocytic astrocytoma, pleomorphic xanthoastrocytoma), oligodendroglial tumors and mixed gliomas (e.g., oligodendroglioma, anaplastic oligodendroglioma, oligoastrocytoma, anaplastic oligoastrocytoma), ependymal tumors (e.g., ependymoma, anaplastic ependymoma, myxopapillary ependymoma, subependymoma), choroid plexus tumors, neuroepithelial tumors of uncertain origin (astroblastoma, chordoid glioma, gliomatosis cerebri), neuronal and mixed-neuronal-glial tumors (e.g., ganglioglioma and gangliocytoma, desmoplastic infantile astrocytoma and ganglioglioma, dysembryoplastic neuroepithelial tumor, central neurocytoma, cerebellar liponeurocytoma, paraganglioglioma), pineal parenchymal tumors, embryonal tumors (medulloepithelioma, ependymoblastoma, medulloblastoma, primitive neuroectodemmal tumor, atypical teratoid/rhabdoid tumor), peripheral neuroblastic tumors, tumors of cranial and peripheral nerves (e.g., schwannoma, neurinofibroma, perineurioma, malignant peripheral nerve sheath tumor), meningeal tumors (e.g., meningeomas, mesenchymal, non-meningothelial tumors, haemangiopericytomas, melanocytic lesions), germ cell tumors, tumors of the sellar region (e.g., craniopharyngioma, granular cell tumor of the neurohypophysis), hemangioblastoma, melanoma, and retinoblastoma. Additionally, the stem cell isolation methods of the invention are applicable to isolating stem cells from tissues other than characterized tumors (e.g., from tissues of diseases such as the so called "stem cell pathologies").

In other aspects, methods for producing dTALE protein using host cells are further provided. In some embodiments of these methods, the method includes culturing the host cell (into which a recombinant expression vector encoding a dTALE polypeptide has been introduced) in a suitable medium until dTALE polypeptide is produced. In some such embodiments, the method further comprises isolating the dTALE polypeptide produced from the medium or the host cell.

Method of Constructing dTALE Polypeptides and Self-Assembled, 5'-3' Ordered Polypeptide Sequences Also provided herein, in some aspects, are methods of constructing self-assembled polypeptide sequences ordered in a predetermined 5' to 3' direction. The methods described herein permit and facilitate the construction of dTALE polypeptides comprising multiple repetitive monomer units for use in modulating target gene expression and targeted genome engineering.

Accordingly, in some aspects provided herein are methods for producing a dTALE polypeptide, the method comprising:

a. generating a plurality of nucleic acid molecules, each of which plurality encodes a polypeptide sequence, and comprises a 5' ligatable junction end, and a 3' ligatable junction end, wherein the sequences of each of the plurality of nucleic acid molecules are selected such that: 1) digesting each of said 5' ligatable junction ends with one or more Type IIs restriction enzymes generates a sticky end overhang that is capable of ligation to a 3' ligatable junction end of another nucleic acid molecule having an orthogonal sticky end sequence; and 2) digesting each of said 3' ligatable junction ends generates a sticky end overhang that is capable of ligation to a 5' ligatable junction end of another nucleic acid molecule having an orthogonal sticky end sequence; 3) the plurality of nucleic acid molecules do not comprise another sequence that can be digested by the one or more Type IIs restriction enzymes; and 4) the 5' ligatable junction end of each of the plurality of nucleic acid molecules is designed to be orthogonal to a 3' ligatable junction end of another nucleic acid molecule of the plurality of nucleic acid molecules according to a predetermined 5' to 3' order of encoded polypeptide sequences, with the exception of the most 5' polypeptide sequence;
b. digesting the plurality of nucleic acid molecules with the one or more Type II restriction enzymes to generate sticky end overhangs at the 5' ligatable junction end and 3' ligation junction end of each of the plurality of nucleic acid molecules;
c. ligating the plurality of nucleic acid molecules; and
d. isolating the desired nucleic acid molecule encoding the self-assembled polypeptide sequences ordered in a predetermined 5' to 3' direction.

Thus, the ligation methods described herein utilizes the unique pairing based on complementarity at each 5'-to-3' ligatable junction of a respective pair of nucleic acid molecules to be joined, engineered using orthogonal restriction enzyme sites at such junction ends, in order to specify the 5' to 3' order of the polypeptides to be self-assembled. Generating the plurality of nucleic acid molecules can be accomplished according to a number of well known techniques in the art, including those described in the Examples. For example, in some embodiments, complementary oligonucleotides containing appropriate monomer unit-encoding and/or junction-end sequences can be synthesized and annealed to form individual nucleic acid molecules encoding monomer units that can then be processed to ligate other monomer-encoding nucleic acid molecules together according to a predetermined 5' to 3' order. Alternatively, in other embodiments, amplification methods, such as polymerase chain reaction, can be used to selectively amplify monomer unit-encoding sequences of interest having the desired junction end sequences by, for example, using linker primer pairs, such as those provided in Tables 4-5 (SEQ ID NOs: 204-255)

In some embodiments of the methods described herein, the identity or sequences of the self-assembled polypeptide sequences, such as monomer units, to be ordered in a predetermined 5' to 3' direction are not limited so long as the 5' and 3' ligatable junction ends of each sequence are appropriately engineered. In some such embodiments, such monomer units can be engineered according to additional steps described above, such as engineering the codons encoding the amino acids of each monomer unit to minimize sequence repetitiveness between the monomer units encoded by the nucleic acid molecule and/or to engineer the most 5' monomer unit to specifically bind a thymine.

In other embodiments of the methods described herein, the 5' and 3' ligatable junction ends of each nucleic acid molecule encoding a polypeptide sequence, such as a monomer unit, to be ordered in a predetermined 5' to 3' direction is generated using polymerase chain reaction and linker primers as described further herein in the Examples. In still other embodiments, each ligated orthogonal 5' to 3' junction end is selected and engineered to preserve the contiguous coding sequence of each encoded polypeptide sequence to be ordered in a predetermined 5' to 3' direction, without insertion or deletion of nucleic acid sequence information in order to generate continuous tandem monomer units.

Useful restriction enzymes for ligation and/or cloning purposes for use in the methods described herein include, without limitation, BtsCI, BsrDI, BtsI, AlwI, BccI, BsmAI, EarI, PleI, BmrI, BsaI, BsmBI, BspQI, FauI, HpyAV, MnlI, SapI, BbsI, BciVI, HphI, MboII, BfuAI, BspCNI, BspMI, SfaNI, HgaI, BseRI, BbvI, EciI, FokI, AcuI, BceAI, BsmFI, BtgZI, BpuEI, BpmI, BsgI, MmeI, and NmeAIII. In addition, T7 DNA ligase is useful in embodiments using sticky end generating restriction enzymes because it has 1000-fold greater activity for sticky end ligation compared to blunt end ligation.

In some embodiments of the methods described herein, all digesting and/or ligation enzymatic reactions can occur simultaneously in the same reaction such that the target combination of self-assembled dTALE polypeptides ordered in a 5' to 3' direction is achieved at one time. Alternatively, in other embodiments of the methods described herein, nucleic acid sequences encoding monomer units can be ligated in several reaction steps, as described herein, thus forming a sequence encoding two or more monomer units, for example, four monomer units, and each of the sequences encoding two or more monomer units can subsequently be ligated to generate a still larger sequence encoding a polypeptide comprising multiple monomer units. Ligation products comprising two or more monomer units can be amplified inbetween subsequent rounds of ligation to result in a larger amount of a sequence encoding a self-assembled dTALE polypeptide for insertion into an expression vector, for example. Identification and selection of the desired dTALE polypeptide or expression vectors comprising the nucleic acid sequence encoding the desired dTALE polypeptide sequence can be performed according to numerous nucleic acid and/or polypeptide isolation methods, including, for example, size fractionation of the molecules have the expected length and/or size, as described herein.

In other embodiments of the methods described herein, the dTALE polypeptide sequences to be ordered in a predetermined 5' to 3' direction can further encode or comprise one or more effector domains, such as those described herein.

The nucleic acids made according to the methods described herein can be cloned into vectors, such as expression vectors, and host cells, according to well known methods described herein. Accordingly, the polypeptides and/or the plurality of nucleic acid molecules generated using the methods provided herein can also be isolated and packaged as kits according to well known methods.

As used herein, the term "nucleic acid molecule" is intended to include DNA molecules (i.e., cDNA or genomic DNA) and RNA molecules (i.e., mRNA) and analogs of the DNA or RNA generated using nucleotide analogs in any number of forms and/or conformations. For example, single-stranded, double-stranded, nuclear, extranuclear, and extracellular nucleic acid forms and/or conformations are all contemplated. An "isolated" nucleic acid molecule is one which is separated from other nucleic acid molecules which are present in a given location (e.g., reaction). In some embodiments "isolated" nucleic acid is free of sequences which naturally flank the nucleic acid (i.e., sequences located at the 5' and 3' ends of the nucleic acid) in the nucleic acid (e.g., genomic DNA) of the organism from which the nucleic acid is derived. For example, in various embodiments, the isolated nucleic acid molecule encoding polypeptide monomers can contain less than about 5 kb, 4 kb, 3 kb, 2 kb, 1 kb, 0.5 kb or 0.1 kb of nucleotide sequences which naturally flank the nucleic acid molecule in the nucleic acid (e.g., genomic DNA) of the cell from which the nucleic acid is derived (e.g., a cell from the genus *Xanthomonas*). Moreover, an "isolated" nucleic acid molecule, such as a cDNA molecule, can be substantially free of other cellular material, or culture medium when produced by recombinant techniques, or chemical precursors or other chemicals when chemically synthesized.

EXAMPLES

Example 1

Design and Synthesis of a Designer Transcription Activator-Like Effector (dTALE)

Described herein are methods for the design, construction, and synthesis of nucleic acid molecules encoding dTALE polypeptides having customized nucleic acid sequence binding properties based, in part, on use of novel ligation strategies (see, for example, FIG. 1B) ("Efficient construction of sequence-specific TAL effectors for modulating mammalian transcription," F. Zhang et al. (2011) *Nat. Biotechnol.* 9:2, 149-154, the contents of each of which are herein.

Common among the entire family of endogenous TALE molecules is a highly conserved, repetitive, central domain comprising tandem repeats of mostly 33 or 34 amino acid monomer units (FIG. 1A). Monomer units differ from each other mainly in amino acid positions 12 and 13 ("variable diresidues"). The repetitive nature of these DNA binding domains of endogenous TALE molecules renders the routine construction of novel TALEs particularly difficult when using existing PCR amplification-based gene construction methods or serial ligation strategies (Kosuri et al. (2010) *Nat. Biotechnol.* 28:1295-1299), even when codon degeneracy is used to minimize the repetitiveness of the endogenous TALE sequences. As a result, the repetitive sequences cross-anneal or cross-hybridize with each other and lead to nonspecific amplification products. Furthermore, commercial services are often unable to guarantee the accuracy of synthesized TALEs owing to these difficulties of repetitive sequence assembly and challenges for sequencing verification.

As demonstrated herein, we developed a novel hierarchical ligation-based strategy to overcome difficulties in constructing nucleic acid binding domains comprising tandem repeats of monomer units for use in designing and synthesizing novel designer TALE (dTALE) polypeptide. To reduce the number of repetitive sequences in TALE molecules, the DNA sequence encoding four 34 amino acid repeat monomer units from the *Xanthomonas* sp. hax3 gene was used to generate 4 variant monomer units that were engineered to minimize homology while preserving the amino acid sequence among the 4 monomers. Each of the variant monomer units had unique diresidue amino acid positions encoded at positions 12 and 13 (i.e., NI, HD, NN, and NG; Table 3). The optimized variant monomer units were synthesized (DNA2.0, Menlo Park, Calif.) and cloned into individual plasmids to be used as amplification templates, as described herein.

Next, a ligation strategy was designed to utilize orthogonal sticky ends to specify the position of each monomer unit in a predetermined 5' to 3' order. The DNA sequence at the junction between each pair of monomer units was engineered such that the Gly-Leu encoded amino acids generated unique sticky ends at the nucleic acid level (Engler et al. (2009) *PLoS One* 4, e5553; Engler et al. (2008) *PLoS One* 3, e3647). Since 4 codons encode Gly and 6 codons encode Leu, the Gly-Leu junction has a total of 24 possible codon pairs with 4 variable bases. Using the 4 base pair variable sequence as sticky-end overhangs in a multi-piece ligation reaction, 24 unique ligation junctions (e.g., using the following unique ligation junctions: ATTA, ATTG, ACTA, ACTG, ACTC, ACTT, CTTA, CTTG, CCTA, CCTG, CCTC, CCTT, GTTA, GTTG, GCTA, GCTG, GCTC, GCTT, TTTA, TTTG, TCTA, TCTG, TCTC, TCTT) can be engineered so as to specify the position of up to 25 monomers in the final assembled tandem repeat. An exemplary dTALE polypeptide unit comprising 12 tandem monomer units would look as shown in FIG. 2.

A destination plasmid containing the N- and C-termini (i.e., the sequences 5' and 3' of the nucleic acid binding domain) of the endogenous TALE hax3 was also constructed so that the ligated dTALE nucleic acid binding domain can be joined with the N- and C-termini to form a fully functional dTALE polypeptide. Specifically, to simplify construction of designer TALE polypeptides, a nucleic acid encoding a dTALE backbone polypeptide comprising an N-terminus sequence of hax3, a single 0.5 monomer unit comprising the variable diresidue NI, and a C-terminus sequence of hax3 was synthesized (DNA2.0) and cloned into a lentiviral expression vector containing the mammalian ubiquitous EF-1a promoter (pLECYT; Zhang et al. (2007) *Nature* 446:633-639).

To allow for insertion of customized monomer units, a linker containing two Type IIs BsmBI sites were inserted between the N-terminus sequence of hax3 and the 0.5 monomer unit. A DNA fragment containing a sequence encoding a mammalian NLS, a transcription activation domain VP64, and 2A-GFP was assembled via PCR assembly and fused to the C-terminus sequence of hax3 of the synthesized dTALE nucleic acid backbone sequence (pLenti-EF1a-dTALE(0.5 NI)-WPRE). HD, NG, and NN versions of the nucleic acid backbone sequence were generated via site directed PCR mutagenesis using QuikChange II XL (Stratagene). The full nucleotide sequences for the four backbone vectors used herein are shown in Table 2.

PCR amplification was then used to generate a set of monomer units for each vector backbone. A set of 24 primers (Table 4) were designed to generate a set of nucleic acid sequences encoding 48 monomer units having engineered 5' and 3' ligation junction ends, such that each monomer unit can be ordered according to its predetermined 5' to 3' direction in the final dTALE polypeptide. Use of type IIs enzymes (e.g., BsaI and BsmBI) allowed for the digestion and processing of the end of each nucleic acid sequence encoding a monomer unit to expose the sticky-end ligation junctions. For example, one of the nucleic acid sequences encoding a monomer unit would look as shown in FIG. 3.

Figure 1B:
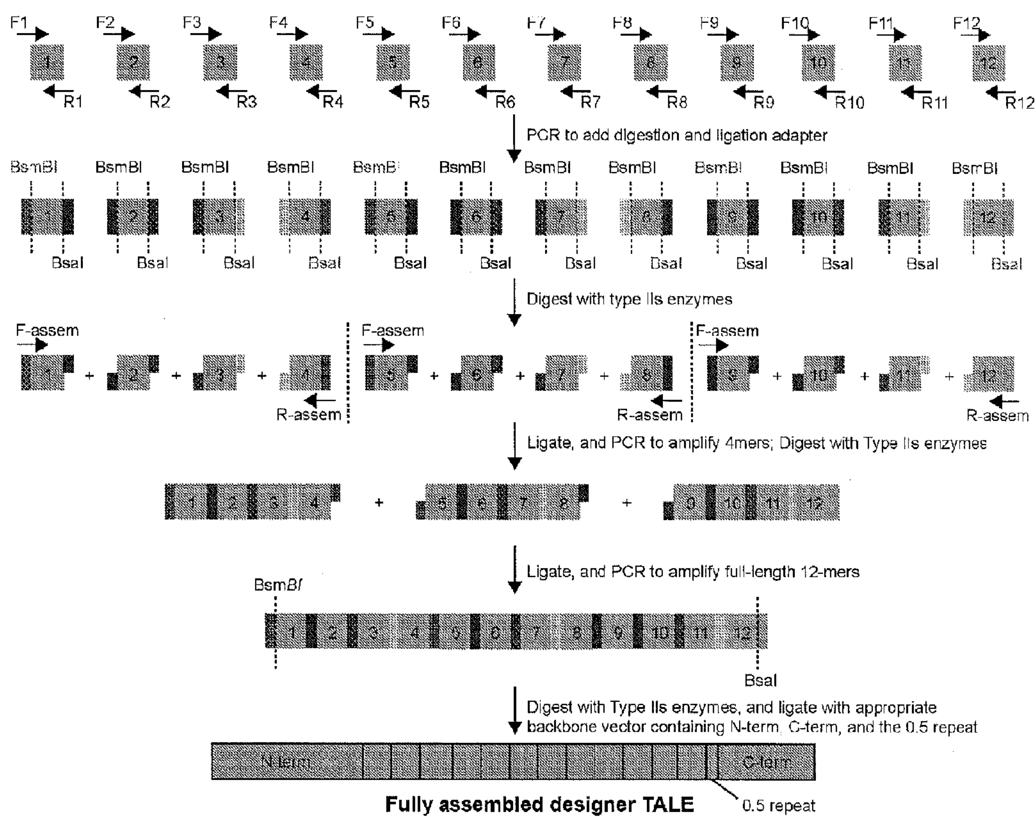

The nucleic acid sequences encoding the monomer units were them ligated into a predetermined 5' to 3' direction (FIG. 1B). A dTALE polypeptide comprising 12 monomer units was constructed in two steps. First, nucleic acid sequences encoding 4 monomer units were assembled in 10 uL ligation reactions consisting of 25 ng of each monomer unit DNA sequence. T7 DNA ligase was used since it has 1000× higher activity on sticky ends relative to blunt ends. The correct size ligation product (~440 bp) for each nucleic acid sequence encoding 4 monomer units was then purified and PCR amplified. The PCR products comprising 4 monomer units were then processed with the appropriate type IIs enzymes, to expose the sticky-end ligation junctions, and then ligated again to form sequences encoding 12 tandem monomer units. The correctly ligated 12-monomer unit product was then PCR amplified and processed with type IIs enzymes for ligation into the backbone vector. The backbone vector comprised a 0.5 length repeat monomer unit specifying a binding site for a $13^{th}$ nucleotide at the C-terminus of the nucleic acid binding domain of the dTALE polypeptide, as well as the N- and C-terminal domains from the *Xathomonas campestris* pv. *armoraciae* endogenous TALE hax3 (FIG. 1B). Seventeen dTALE polypeptides having specific combinations of 12.5 monomer units were constructed to target 14 base pair sequences (i.e., the 5' most monomer unit targets a thymine, the engineered 12 monomer units target a predetermined 12 base pair sequence, and the 0.5-monomer unit at the 3' end targets a $13^{th}$ base pair) within 3 days, a fraction of the time necessary to generate similar numbers of designer nucleic acid binding-zinc finger proteins. The final assembled dTALE polypeptides can be verified using nucleic acid sequencing methods, as known to one of ordinary skill in the art.

Example 2

Alternative Design and Synthesis of a Designer Transcription Activator-Like Effector (dTALE)

The primer set shown in Table 4 was designed for optimizing the dTALE polypeptide assembly procedure. Each sequence encoding a monomer unit comprised two different restriction sites flanking the 5' and 3' ends. In order to further simplify the construction methods described herein, a number of ligation conditions were tested by varying the number of pieces being ligated simultaneously and it was found that a 4-piece ligation system worked very efficiently. To avoid the need for double digests using two different restriction enzymes at different temperatures, the dTALE polypeptide construction protocol described in Example 1 and primer design (Table 5), was adapted to streamline the assembly process, as described herein.

An exemplary step-by-step protocol for simplified construction of nucleic acid molecules encoding a dTALE polypeptide is presented herein. First, a library ccomprising 48 monomer unit sequences (4 monomer unit sequences for each position in the final assembled 12 monomer unit tandem repeat) is generated using PCR. Plasmids containing each type of monomer unit (monomer sequence listed in Table 3) are used as the template for amplification. PCR reactions are set up for each monomer, according to the following primer:template using the primers shown in Table 5.

| | | | | | | |
|---|---|---|---|---|---|---|
| Primer: | F1/R1 | F2/R2 | F3/R3 | F4/R4 | F5/R5 | F6/R6 |
| Tem- | NI | NI | NI | NI | NI | NI |
| plate: | F1/R1 | F2/R2 | F3/R3 | F4/R4 | F5/R5 | F6/R6 |
| | HD | HD | HD | HD | HD | HD |
| | F1/R1 | F2/R2 | F3/R3 | F4/R4 | F5/R5 | F6/R6 |
| | NG | NG | NG | NG | NG | NG |
| | F1/R1 | F2/R2 | F3/R3 | F4/R4 | F5/R5 | F6/R6 |

-continued

| | | | | | |
|---|---|---|---|---|---|
| NN | NN | NN | NG | NN | NN |
| F7/R7 | F8/R8 | F9/R9 | F10/R10 | F11/R11 | F12/R12 |
| NI | NI | NI | NI | NI | NI |
| F7/R7 | F8/R8 | F9/R9 | F10/R10 | F11/R11 | F12/R12 |
| HD | HD | HD | HD | HD | HD |
| F7/R7 | F8/R8 | F9/R9 | F10/R10 | F11/R11 | F12/R12 |
| NG | NG | NG | NG | NG | NG |
| F7/R7 | F8/R8 | F9/R9 | F10/R10 | F11/R11 | F12/R12 |
| NN | NN | NN | NN | NN | NN |

For PCR amplification of sequences encoding monomer units, high-fidelity polymerase (e.g., Herculase II from Stratagene) is used to minimize mutation and achieve the highest product yield. Sequences encoding monomer units are amplified in 100 μl PCR reactions following appropriate protocols of polymerase manufacturers. After completion of the PCR reaction, each monomer unit PCR product is purified using the 96 QIAquick PCR Purification Kit (Qiagen) and the product eluted in 70 μl of ddH2O. Each monomer unit PCR product is digested using BsaI (New England BioLabs) at 37° C. for 1 hour in a 100 μl reactions as follows: 70 μl purified PCR Product, 5 μl BsaI (50 units), 5 μl 10× Buffer #4, 1 μl 100× BSA, and 19 μl ddH2O.

After digestion, digested monomer unit PCR products are purified using the 96 QIAquick PCR Purification Kit (Qiagen) and eluted in 70 μl of ddH2O. The concentration of each monomer unit PCR product is adjusted to 25 ng/μl for monomer unit PCR products 1, 4, 5, 8, 9, and 12; and 20 ng/μl for monomer unit PCR product 2, 3, 6, 7, 10, and 11. For each dTALE polypeptide to be assembled, individual tandem repeats comprising 4 monomer unit nucleic acid sequences are first constructed by simultaneously ligating 4 monomer unit nucleic acid sequences together at equal molar ratio (25 ng for monomer unit 1 and 4, 20 ng for monomer units 2 and 3 in 10 ul total ligation mix, using 300 units of T7 ligase from Enzymatics and 10× ligation buffer). The ligation is incubated at room temperature for 30 minutes. 8.5 μl of the ligation reactions comprising 4 monomer unit nucleic acid sequences are run on a 2% E-Gel EX (Invitrogen) and the correct size products are amplified by gel-stab PCR3. Specifically, a 10 μL pipette tip is used to puncture the gel at the location of the desired product. The stab is mixed up and down in 10 μL of water, and the water is heated to 65° C. for 2 min. 2.5 μL of the gel-isolated product diluted in water is then amplified in a 50 μL PCR reaction using Herculase II polymerase (Stratagene). The amplified PCR products comprising 4 tandem monomer unit nucleic acid sequences are purified using the QIAquick PCR Purification kit and eluted in 40 μl of ddH2O.

Purified amplified PCR products comprising 4 tandem monomer units as well as the appropriate dTALE backbone vector are digested using BsmBI at 55° C. for 1 hour using 40 ul purified PCR product (with 5 ul 10× Buffer #3 and 5 ul BsmBI (50 units)) and 500 ng dTALE backbone vector (with 5 ul 10× Buffer #3 and 5 ul BsmBI (50 units)). The volume is brought up to 50 ul with ddH2O. Then, digested amplified PCR products comprising 4 tandem monomer units are purified using QIAquick PCR Purification Kit (Qiagen). The digested dTALE backbone vector is gel purified as well. Fully assembled nucleic acid sequences encoding a dTALE polypeptide are generated by simultaneously ligating the three amplified PCR products comprising 4 tandem monomer unit nucleic acid sequences with the backbone vector at equal molar ratio (1 ng for each 4-mer tandem repeat and 28 ng for backbone vector; in a 10 ul ligation reaction using 1500U T7 ligase from Enzymatics). A negative control reaction should be set up with 28 ng of the backbone vector alone. All ligation reactions are incubated in a thermal cycler using the following parameters: 37° C. for 1 min followed by 25° C. for 5 min, for 30 cycles. Two ul of each dTALE ligation reaction is transformed into XL-10 Gold chemically competent cells (Stratagene). Plasmid DNA for assembled nucleic acid sequences encoding dTALE polypeptides are prepared from ligation transformants and analyzed via restriction digest and DNA sequencing. Transformation of the negative control ligation should not yield any transformants.

Example 3 dTALE Nucleic Acid Binding and Effector Function

Figure 4:
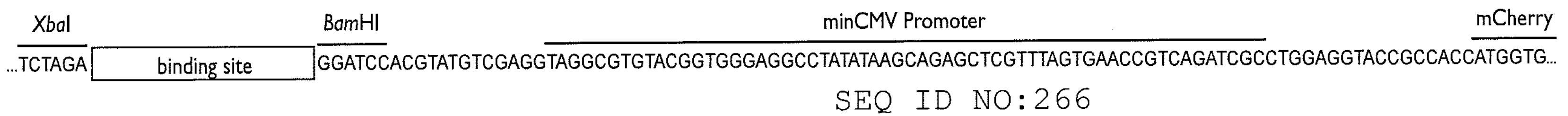
FIG. 4 shows a schematic representation of an embodiment of a design of a reporter plasmid for use in testing dTALE polypeptides generated using the methods described herein. A target nucleic acid sequence of a dTALE polypeptide was cloned into a mCherry reporter plasmid between XbaI and BamHI restriction sites, such that the dTALE binding site is placed −96 bp upstream of the transcription start site of a full-length mCherry gene, with a minimal CMV promoter in the middle.

In order to determine whether dTALE polypeptides synthesized using the methods described herein can target nucleic acids and have effector function(s) in mammalian cells, a fluorescence-based reporter system was engineered by placing the nucleic acid sequence encoding a predetermined nucleic acid binding site for each dTALE polypeptide upstream of a minimal CMV promoter driving expression of the fluorescent protein, mCherry (FIGS. 1C and 4). The mCherry reporter plasmids carrying nucleic acid sequences encoding a predetermined dTALE nucleic acid binding site were generated by inserting sequences comprising the binding site upstream of the minimal CMV promoter (FIG. 4)

To generate nucleic acid sequences encoding dTALE polypeptides, the sequences of the endogenous nuclear localization signal (NLS) and acidic transcription activation domain (AD) of the endogenous TALE hax3 was replaced with the sequence of a mammalian nuclear localization signal (NLS) and the synthetic transcription activation domain VP64 (FIG. 1C). To allow quantitative comparison of dTALE polypeptide activity, a self-cleaving green fluorescent protein (GFP) was fused to the C-terminus of each dTALE polypeptide, so that the relative level of dTALE polypeptide expression could be quantified using GFP fluorescence measurements.

Human embryonic kidney cell line 293 FT (Invitrogen) were maintained under 37° C., 5% CO2 conditions using Dulbecco's modified Eagle's medium supplemented with 10% fetal bovine serum, 2 mM GlutaMAX (Invitrogen), 100 U/mL Penicillin, and 100 μg/mL Streptomycin. For transfection of expression vectors encoding dTALE polypeptides and reporter plasmids, a total number of $2\times10^5$ of $0.8\times10^4$ 293FT cells were seeded to each well of a 24-well or 96-well plate, respectively, prior to transfection. Approximately 24 hours after initial seeding, the 293 FT cells were transfected using Lipofectamine 2000 following manufacturer's protocols (Invitrogen). For 24-well plates, 500 ng of expression vectors encoding dTALE polypeptides and 30 ng of reporter plasmids per well were used. For 96-well plates, 100 ng of expression vectors encoding dTALE polypeptides and 1 ng of reporter plasmids per well were used.

Co-transfection of an expression vectors encoding a dTALE polypeptide (dTALE1) and its corresponding reporter plasmid in 293FT cells led to robust mCherry fluorescence (FIG. 1D; scale bar is 200 μm). In contrast, transfection of 293 FT cells with the reporter construct alone did not yield appreciable levels of fluorescence (FIG. 1D; scale bar is 200 μm). The level of reporter induction was quantified by measuring the ratio of total mCherry fluorescence intensity between cells co-transfected with expression vectors encoding a dTALE polypeptide and its corresponding reporter plasmid, and cells transfected with the reporter plasmid alone. mCherry reporter activation was assayed via flow cytometry using a LSRFortessa cell analyzer (BD Biosciences). Cells were trypsinized from their culturing plates approximately 18 hours after transfection and resuspended in 200 μl of media for flow cytometry analysis. The flow cytometry data was analyzed using BD FACSDiva (BD Biosciences). At least 25,000 events were analyzed for each transfection sample. The fold induction of mCherry reporter gene by expressed dTALE polypeptides was determined via flow cytometry analysis of mCherry expression in transfected 293FT cells, and calculated as the ratio of the total mCherry fluorescence intensity of cells from transfections with and without the specified dTALE polypeptide. All fold induction values were normalized to the expression level of dTALE polypeptide as determined by the total GFP fluorescence for each transfection. Thus, as demonstrated herein, dTALE polypeptides designed and generated using the methods described herein are capable of recognizing their predicted target DNA sequences in mammalian cells.

Example 4 dTALE Nucleic Acid Binding Specificity

It was next determined whether the DNA recognition code for the nucleic acid binding domain of dTALE polypeptides is sufficiently modular such that a dTALE polypeptide can be customized to target any DNA sequence of interest. 293FT cells were seeded in 6-well plates. 4 μg of a dTALE expression vector was transfected using Lipofectamine 2000 (Invitrogen). Transfected cells were cultured at 37° C. for 48 hours and sorted for the GFP positive population using a BD FACSAria (BD Biosciences) machine to obtain cells that were successfully transfected and expressing dTALE polypeptide. At least 1,000,000 cells were harvested and subsequently processed for total RNA extraction using the RNAeasy Mini Kit (Qiagen). cDNA was generated using the iScript cDNA Synthesis Kit (Bio-Rad) according to the manufacturer's recommended protocol. Oct4, Sox2, cMyc, and Klf4 mRNA were detected using TaqMan Gene Expression Assays (Applied Biosystems: Oct4-Hs00999632_g1, Sox2-Hs00602736_s1, cMyc-Hs00905030_m1, Klf4-Hs01034973_g1)

Figure 5A:
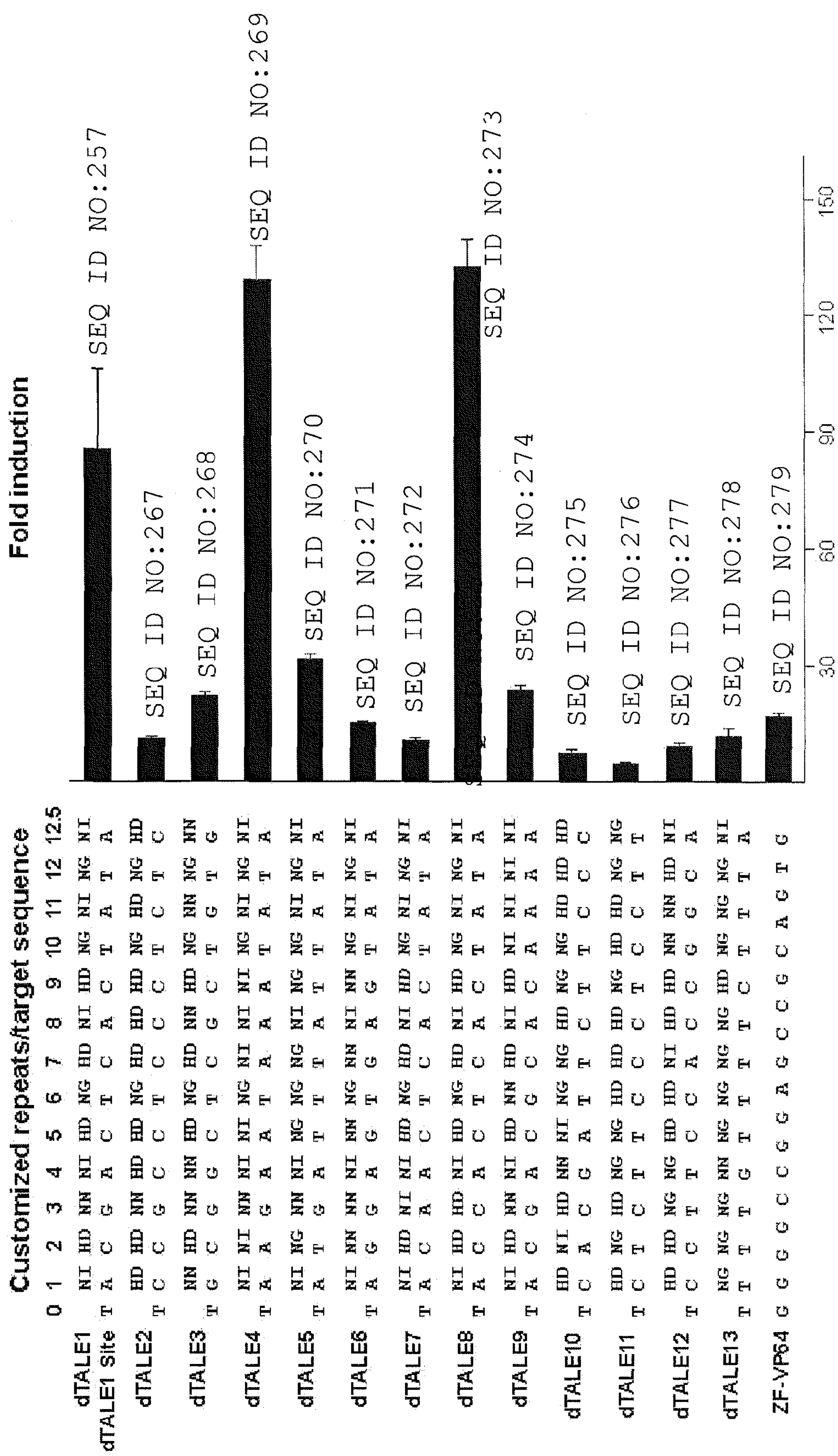
FIGS. 5A-5D show results of characterization of the robustness and specificity of dTALE-DNA recognition in mammalian cells. Thirteen different dTALE polypeptides were tested with their corresponding reporter constructs comprising their target nucleic acid sequence. Customized monomer units and corresponding target nucleic acid sequences are shown on the left. The activities of the dTALE polypeptides on target gene expression are shown on the right as the fold induction of the mCherry reporter gene. Fold induction was determined by flow cytometry analysis of mCherry expression in transfected 293FT cells, and calculated as the ratio of the total mCherry fluorescence intensity of cells transfected with and without the specified dTALE polypeptide, normalized by the GFP fluorescence to control for transfection efficiency differences.

Ten of thirteen (77%) distinct dTALE polypeptides generated in Example 1 and engineered to target a range of DNA binding sites with different DNA sequence compositions drove robust mCherry expression (>10-fold) from their corresponding reporters (FIG. 5A). Three dTALE polypeptides exhibited more than 50-fold reporter induction (dTALE1, dTALE4, and dTALE8), and only one out of thirteen dTALEs (dTALE11) generated less than 5 fold induction of mCherry reporter expression (FIG. 5A). As a positive control, an artificial zinc finger-VP64 (ZF-VP64) fusion was constructed, where the ZF has previously been shown to activate transcription from a binding site in the human erbB-2 promoter (Beerli et al. (1998) *PNAS* 95:14628-14633). This artificial ZF-VP64 protein was tested using the same mCherry reporter assay and demonstrated around 16 fold mCherry reporter activation. The data indicate that sequence-specific dTALE polypeptides can be easily designed and synthesized to target a wide spectrum of DNA binding sites at a similar or greater level as artificial ZF-VP64 transcription factors and whose fold induction can further be predicted or engineered based upon structural data of TALE repeat units (Murakami et al. (2010) *Proteins* 78:3386-3395).

Figure 5B:
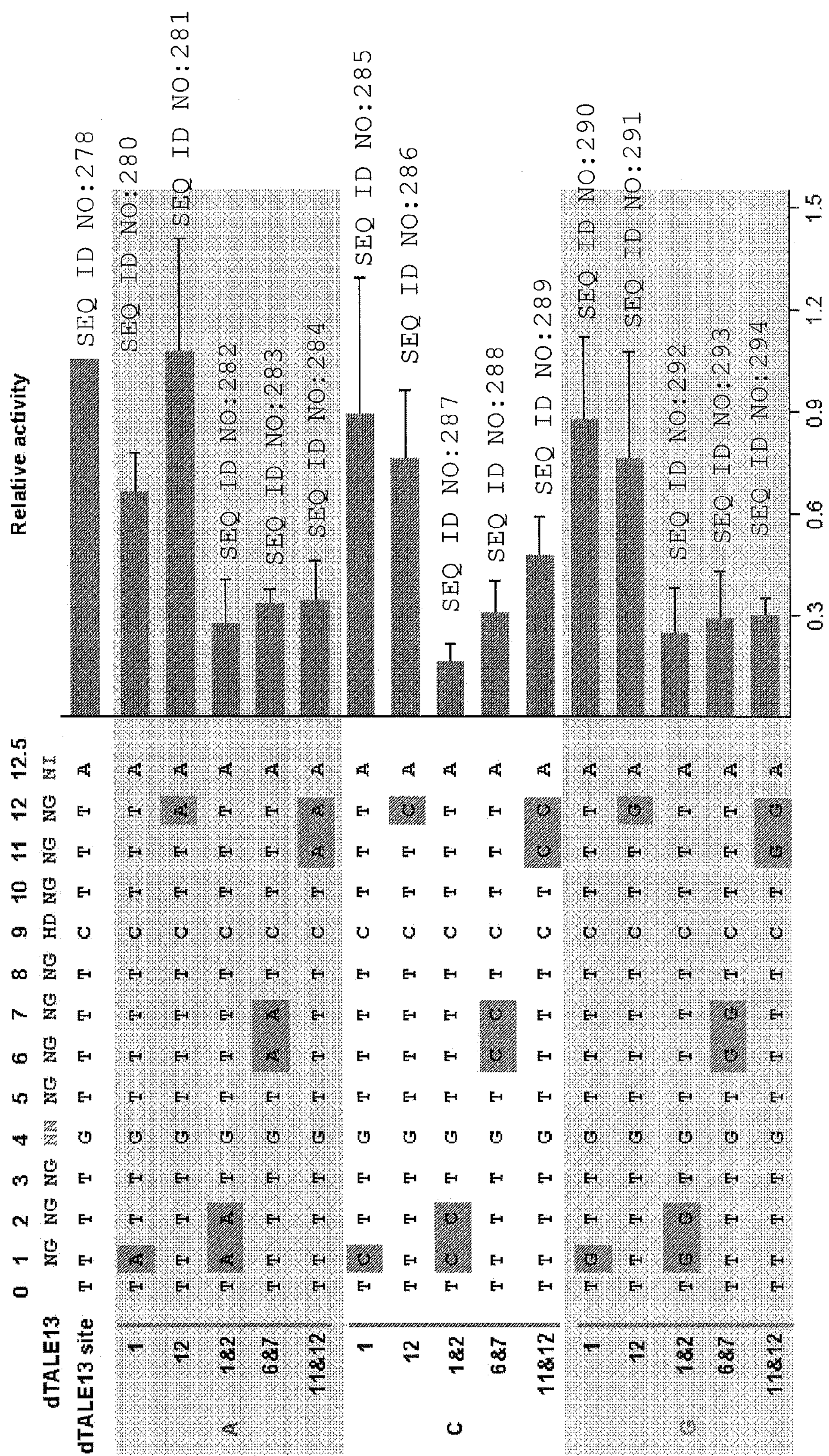

To further characterize the robustness of dTALE polypeptides and their DNA binding specificity, a series of mutant reporter constructs was generated for dTALE13 polypeptide by systematically altering the target nucleotide within the dTALE13 polypeptide nucleic acid binding domain to test the significance of mismatch position and number on dTALE polypeptide activity (FIG. 5B; all error bars indicate s.e.m., n=3; relative activity of dTALE13 polypeptide for each mutant reporter compared to the original reporter is shown). It was found that for all single base pair mutations in the target nucleic acid sequence, dTALE13 polypeptide activity decreased by less than 40% but with varying efficiency for different types of mismatches (A, T, and G). A trend for increased mismatch tolerance toward the C-terminus of the dTALE13 polypeptide nucleic acid binding domain was also observed, especially when comparing activity of dTALE13 polypeptides over reporters with binding site mutations at positions 1&2, 6&7, and 11&12 (FIG. 5B). Moreover, binding sites carrying two mismatching base pairs exhibited more than 70% reduction in transcriptional activity (FIG. 5B) in positions 1&2, and relaxed to around 50% activity reduction in positions 9&10. The two-mismatch experiments indicate that dTALE polypeptides have sufficiently discriminatory capability to distinguish between two binding sites differing by two base pairs. All fold inductions were determined via flow cytometry analysis of mCherry expression in transfected 293FT cells and calculated as the ratio of the number of fluorescent cells from transfections with and without the specified dTALE polypeptide.

Figure 5C:
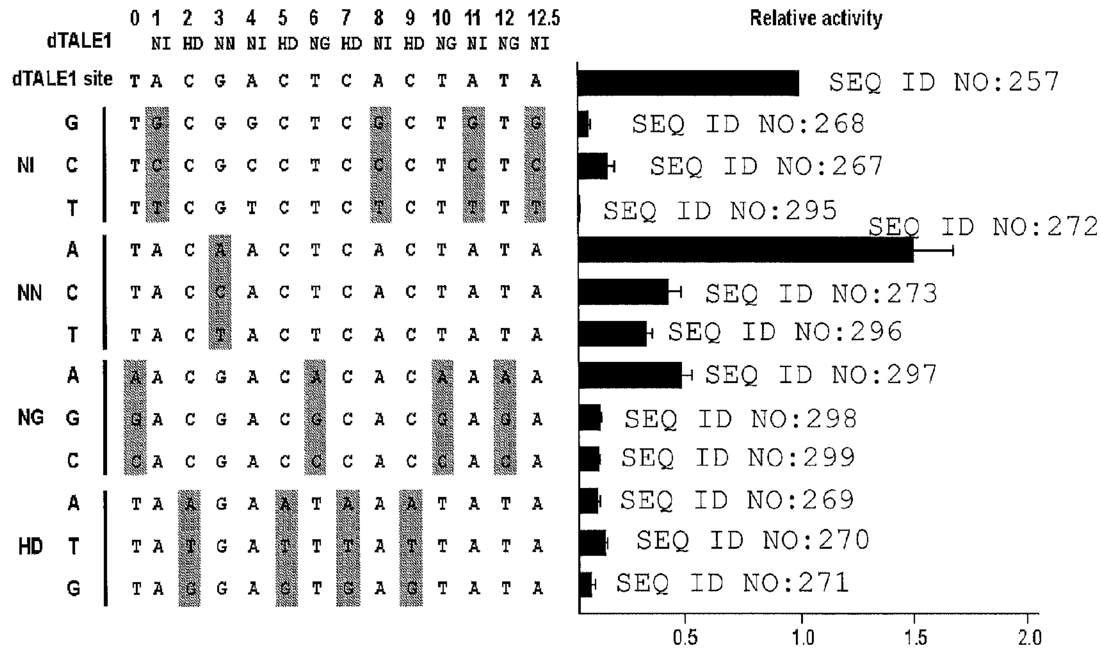
Figure 5D:
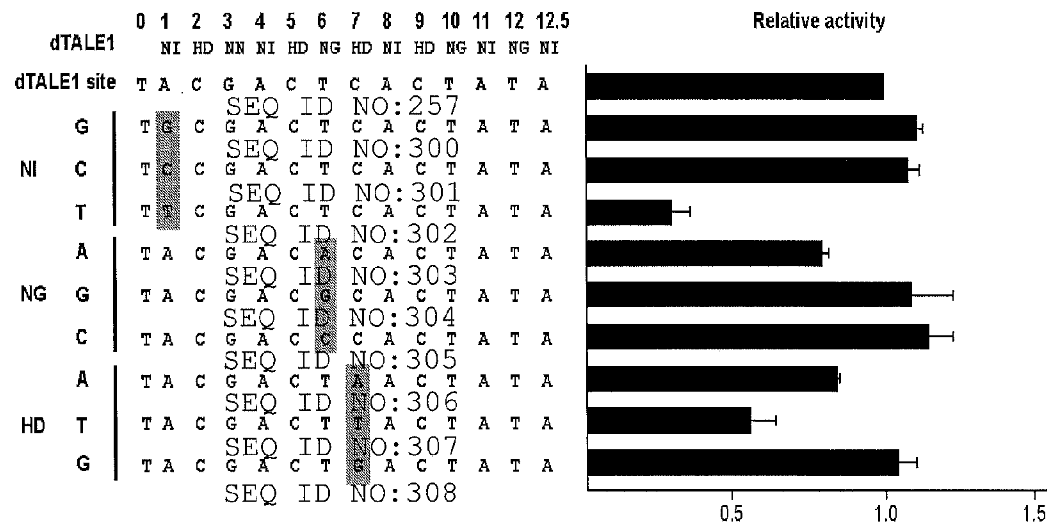

In addition, each variable diresidue in dTALE1 polypeptide was tested against its non-preferred DNA bases to determine the binding specificty for each variable diresidue (FIG. 5C; all error bars indicate s.e.m., n=3). Single base pair mismatches were used to test the binding specificity of dTALE1 polypeptide and the relative activity of dTALE1 polypeptide for each mutant reporter compared to the intended reporter was determined (FIG. 5D; all error bars indicate s.e.m., n=3). The fold induction was determined via flow cytometry analysis of mCherry expression in transfected 293 FT cells, and calculated as the raio of the total mCherry fluorescence intensity of cells transfected with and without the specified dTALE polypeptide.

Each fully assembled dTALE polypeptide has more than 800 amino acids and so it was next determined what minimal N- and/or C-terminal capping regions may be needed for DNA binding activity. A series of N-terminal dTALE1 polypeptide truncation mutants were generated (FIG. 6A) and it was found that transcriptional activity is inversely correlated with the N-terminus length. Deletion of 48 amino acids from the N-terminus (truncation mutant N1-C0) retained the same level of transcription activity as the full length N-term dTALE1 polypeptide, while deletion of 141 aa from the N-term (truncation mutant N2-C0; FIG. 6B) retained ~80% of transcription activity. Therefore, truncation position N1 was chosen for all subsequent studies given its full transcriptional activity.

Similar truncation analysis in the C-terminus revealed that an important element for DNA binding resides within the first 68 amino acids (FIG. 6C). Truncation mutant N1-C3 retained the same level of transcriptional activity as the full C-terminus, whereas truncation mutant N1-C4 reduces dTALE1 activity by more than 50%. Therefore in order to preserve the highest level of dTALE polypeptides activity, ~68 amino acids of the C-terminus of hax3 should be preserved.

Example 5 dTALE-Driven Transcriptional Modulation of Mammalian Genomic Genes

In order to test whether dTALE polypeptides can be used to modulate transcription of endogenous genes, 4 additional dTALE polypeptides were engineered to directly activate transcription of the pluripotency transcription factors, Sox2, Klf4, c-Myc, and Oct4. dTALE polypeptide binding sites were selected from the proximal 200 bp promoter region of each gene (FIG. 7A). To assay the DNA binding activity of the 4 new dTALE polypeptides, the mCherry reporter assay described above was used. Three out of four dTALE polypeptides (Sox2-dTALE polypeptide, Klf4-dTALE polypeptide, and cMyc-dTALE polypeptide) exhibited greater than 20-fold of mCherry reporter activation (FIGS. 7A and 7B).

To test the activity of dTALE polypeptides specific for pluripotency transcription factor promoters on endogenous genes, each dTALE polypeptide was transfected into 293FT cells and mRNA levels of each target gene were quantified using qRT-PCR. dTALE-Sox2 polypeptide and dTALE-Klf4 polypeptide were able to upregulate their respective target genes by 5.5±0.1 and 2.2±0.1 fold (FIG. 7C; bars represent the levels of Sox2 or Klf4 mRNA in the transfected cell as determined via quantitative RT-PCR. Mock consists of cells receiving the transfection vehicle and dTALE1 polypeptide is used as a negative control. All error bars indicate s.e.m.; n=3. *** $p<0.005$.), thereby demonstrating that dTALE polypeptides can be used to modulate transcription from the genome. To control for specificity of activation, 293FT cells were transfected in parallel with dTALE1, which was not designed to target either Sox2 or Klf4, and no change in the level of Sox2 or Klf4 expression relative to the mock control was found. In addition, a statistically significant decrease in the level of Klf4 mRNA in 293FT cells transfected with Sox2-dTALE polypeptide (approximately a 2-fold reduction) was observed. This may be due to secondary cross-regulation among reprogramming factors (Xu et al. (2009) *Cell* 137:647-658 and Wei et al. (2009) *Stem Cells* 27:2969-2978). Together, the data described herein demonstrates that dTALE polypeptide can be designed to bind and specifically modulate transcription from the promoters of endogenous mammalian genes.

TABLE 1

| Endogenous TALE Polypeptide Sequences |
|---|
| SEQ ID NO: 4<br>>gi\|155355\|gb\|AAA27592.1\| aurBsP [*Xanthomonas campestris*]<br>MDPIRSRTPSPARELLPGPQPDGVQPTADRGVSPPAGGPLDGLPARRTMSRTRLPSPPAPSPAFSAGSFS<br>DLLRQFDPSLFNTSLFDSLPPFGAHHTEAATGEWDEVQSGLRAADAPPPTMRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QDMIAALPEATHEAIVGVGKQWSGARALEALLTVAGELRGPPLQLDTGQLLKIAKRGGVTAVEAVHAWRN<br>ALTGAPLNLTPEQVVAIASNIGGKQALETVQALLPVLCQAHGLTPDQVVAIASNGGGKQALETVQRLLPV<br>LCQAHGLTPEQVVAIASNIGGKQALETVQRLLPVLCQAHGLTPEQVVAIASNIGGKQALETVQRLLPVLC<br>QAHGLTPEQVVAIASNGGGKQALETVQRLLPVLCQAHGLTPEQVVAIASNGGGKQALETVQRLLPVLCQA<br>HGLI |
| SEQ ID NO: 5<br>>gi\|297451\|emb\|CAA48680.1\| avirulence protein avrBs4 [*Xanthomonas vesicatoria*]<br>MDPIRSRTPSPARELLPGPQPDGVQPTADRGVSPPAGGPLDGLPARRTMSRTRLPSPPAPSPAFSAGSFS<br>DLLRQFDPSLFNTSLFDSLPPFGAHHTEAATGEWDEVQSGLRAADAPPPTMRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QDMIAALPEATHEAIVGVGKQWSGARALEALLTVAGELRGPPLQLDTGQLLKIAKRGGVTAVEAVHAWRN<br>ALTGAPLNLTPEQVVAIASNIGGKQALETVQALLPVLCQAHGLTPDQVVAIASNGGGKQALETVQRLLPV<br>LCQAHGLTPEQVVAIASNIGGKQALETVQRLLPVLCQAHGLTPEQVVAIASNIGGKQALETVQRLLPVLC<br>QAHGLTPEQVVAIASNGGGKQALETVQRLLPVLCQAHGLTPEQVVAIASNGGGKQALETVQRLLPVLCQA<br>HGLIPQQVVAIASNIGGKQALETVQRLLPVLCQDHGLTPQQVVAIASNSGGKQALETVQRLLPVLCQAHG<br>LTPEQVVAIASNGGGKQALETVQRLLPVLCQAHGLTPQQVVAIASNIGGKQALETVQRLLPVLCQDHGLT<br>PQQVVAIASNSGGKQALETVQRLLPVLCQAHGLTPQQVVAIASNGGGKQALETVQRLLPVLCQAHGLTPQ<br>QVVAIASHDGGKQALETVQRLLPVLCQAHGLTPQQVVAIASHDGGKQALETVQRLLPVLCQAHGLTPQQV<br>VAIASNSGGKQALETVQRLLPVLCQAHGLTPQQVVAIASHDGGKQALETVQRLLPVLCQAHGLTPQQVVA<br>IASNGGGKQALETVQRLLPVLCQAHGLTPQQVVAIASNGGGRPALESIVAQLSRPDPALAALTNDHLVAL<br>ACLGGRPALDAVKKGLPHAPALIKRTNRRIPERTSHRVADHAQVVRVLGFFQCHSHPAQAFDDAMTQFGM<br>SRHGLLQLFRRVGVTELEARSGTLPPASQRWDRILQASGMKRAKPSPTSTQTPDQASLHAFADSLERDLD<br>APSPMHEGDQTRASSRKRSRSDRAVTGPSAQQSFEVRVPEQRDALHLPLSWRVKRPRTSIGGGGTPTAAD<br>LAASSTVMREQDEDPFAGAADDFPAFNEEELAWLMELLPQ |
| SEQ ID NO: 6<br>>gi\|899439\|gb\|AAC43587.1\| PthA [*Xanthomonas citri*]<br>MDPIRSRTPSPARELLPGPQPDGVQPTADRGVSPPAGGPLDGLPARRTMSRTRLPSPPAPSPAFSAGSFS<br>DLLRQFDPSLFNTSLFDSLPPFGAHHTEAATGEWDEVQSGLRAADAPPPTMRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QDMIAALPEATHEAIVGVGKQWSGARALEALLTVAGELRGPPLQLDTGQLLKIAKRGGVTAVEAVHAWRN<br>ALTGAPLNLTPEQVVAIASNIGGKQALETVQRLLPVLCQAHGLTPEQVVAIASNGGKQALETVQRLLPVL<br>CQAHGLTPEQVVAIASNIGGKQALETVQRLLPVLCQAHGLTPEQVVAIASNIGGKQALETVQRLLPVLCQ<br>AHGLTPAQVVAIASNIGGKQALETVQRLLPVLCQAHGLTPEQVVAIASNGGGKQALETVQRLLPVLCQAH<br>GLTPDQVVAIASHDGGKQALETVQRLLPVLCQAHGLTPQQVVAIASNGGGKQALETVQRLLPVLCQAHGL<br>TPEQVVAIASHDGGKQALETVQRLLPVLCQAHGLTPEQVVAIASNGGGKQALETVQRLLPVLCQAHGLTP<br>EQVVAIASNGGGKQALETVQRLLPVLCQAHGLTPEQVVAIASNGGGKQALETVQRLLPVLCQAHGLTLDQ<br>VVAIASNGGGKQALETVQRLLPVLCQAHGLTPEQVVAIASNSGGKQALETVQRLLPVLCQAHGLTPDQVV<br>AIASHDGGKQALETVQRLLPVLCQAHGLTPEQVVAIASHDGGKQALETVQRLLPVLCQAHGLTPEQVVAI<br>ACNGGGKQALETVQRLLPVLCQAHGLTPEQVVAIASNGGGRPALESIVAQLSRPDPALAALTNDHLVALA<br>CLGGRPALDAVKKGLPHAPALIKRTNRRIPERTSHRVADHAQVVRVLGFFQCHSHPAQAFDDAMTQFGMS |

TABLE 1-continued

| Endogenous TALE Polypeptide Sequences |
|---|
| RHGLLQLFRRVGVTELEARSGTLPPASQRWDRILQASGMKRAKPSPTSTQTPDQASLHAFADSLERDLDA<br>PSPTHEGDQRRASSRKRSRSDRAVTGPSAQQSFEVRAPEQRDALHLPLSWRVKRPRTSIGGGLPDPGTPT<br>AADLAASSTVMREQDEDPFAGAADDFPAFNEEELAWLMELLPQ |
| SEQ ID NO: 7<br>>gi\|1236702\|gb\|AAA92974.1\| avirulence protein AvrXa10 [*Xanthomonas oryzae*]<br>MDPIRSRTPSPARELLPGPQPDRVQPTADRGGAPPAGGPLDGLPARRTMSRTRLPSPPAPSPAFSAGSFS<br>DLLRQFDPSLLDTSLLDSMPAVGTPHTAAAPAECDEVQSGLRAADDPPPTVRVAVTARPPRAKPAPRRRA<br>AQPSDASPAAQVDLRTLGYSQQQQEKIKPKVRSTVAQHHEALVGHGFTHAHIVALSQHPAALGTVAVTYQ<br>DIIRALPEATHEDIVGVGKQWSGARALEALLTEAGELRGPPLQLDTGQLLKIAKRGGVTAVEAVHAWRNA<br>LTGAPLNLTPDQVVAIASNIGGNQALETVQRLLPVLCQAHGLTPDQVVAIASHGGGKQALETVQRLLPVL<br>CQAHGLTPDQVVAIASNIGGKQALATVQRLLPVLCQDHGLTPDQVVAIASHGGGKQALETVQRLLPVLCQ<br>DHGLTPDQVVAIASNIGGKQALETVQRLLPVLCQDHGLTPDQVVAIASNIGGKQALETVQRLLPVLCQDH<br>GLTPDQVVAIASNNGGKQALETVQRLLPVLCQTHGLTPDQVVAIANHDGGKQALETVQRLLPVLCQDHGL<br>TPDQVVAIASNIGGKQALATVQRLLPVLCQAHGLTPDQVVAIASHDGGKQALETVQRLLPVLCQDHGLTP<br>DQVVAIASNNGGKQALETVQRLLPVLCQDHGLTPAQVVAIANHGGGKQALETVQRLLPVLCQDHGLTPVQ<br>VVAIASNSGGKQALETVQRLLPVLCQDHGLTPVQVVAIASNGGGKQALATVQRLLPVLCQDHGLTPVQVV<br>AIASHDGGKQALETVQRLLPVLCQDHGLTPDQVVAIASNGGKQALESIVAQLSRPDPALAALTNDHLVAL<br>ACLGGRPALDAVKKGLPHAPELIRRINRRIPERTSHRVADLAHVVRVLGFFQSHSHPAQAFDDAMTQFGM<br>SRHGLAQLFRRVGVTELEARYGTLPPASQRWDRILQASGMKRVKPSPTSAQTPDQASLHAFADSLERDLD<br>APSPMHEGDQTRASSRKRSRSDRAVTGPSTQQSFEVRVPEQQDALHLPLSWRVKRPRTRIGGGLPDPGTP<br>IAADLAASSTVMWEQDAAPFAGAADDFPAFNEEELAWLMELLPQSGSVGGTI |
| SEQ ID NO: 8<br>>gi\|1330244\|gbAAB00675.1\| Avrb6 [*Xanthomonas citri* subsp. *malvacearum*]<br>MDPIRSRTPSPARELLPGPQPDGVQPTADRGVSPPAGGPLDGLPARRTMSRTRLPSPPAPSPAFSAGSFS<br>DLLRQFDPSLFNTSLFDSLPPFGAHHTEAATGEWDEVQSGLRAADAPPPTMRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QDMIAALPEATHEAIVGVGKQWSGARALEALLTVAGELRGPPLQLDTGQLLKIAKRGGVTAVEAVHAWRN<br>ALTGAPLNLTPEQVVAIASHDGGKQALETVQRLLPVLCQAHGLTPEQVVAIASNIGGKQALETVQALLPV<br>LCQAHGLTPEQVVAIASNGGGKQALETVQRLLPVLCQAHGLTPEQVVAIASHDGGKQALETVQRLLPVLC<br>QAHGLTPEQVVAIASHDGGKQALETVQRLLPVLCQAHGLTPEQVVAIASNIGGKQALETVQRLLPVLCQA<br>HGLPPEQVVAIASHDGGKQALETVQRLLPVLCQAHGLTLDQVVAIASNIGGKQALETVQRLLPVLCQAHG<br>LTPQQVVAIASNSGGKQALETVQRLLPVLCQAHGLTPEQVVAIASHDGGKQALETVQRLLPVLCQAHGLT<br>PEQVVAIASHDGGKQALETVQRLLPVLCQAHGLTPEQVVAIASHDGGKQALETVQRLLPVLCQAHGLTPA<br>QVVAIASNNGGKQALETVQRLLPVLCQAHGLTPEQVVAIASNGGGRPALESIVAQLSRPDPALAALTNDH<br>LVALACLGGRPALDAVKKGLPHAPALIKRTNRRIPERTSHRVADHAQVVRVLGFFQCHSHPAQAFDDAMT<br>QFGMSRHGLVQLFRRVGVTELEARSGTLPPASQRWDRILQASGMKRAKPSPTSTQTPDQASLHAFADSLE<br>RDLDAPSPMHEGDQTRASSRKRSRSDRAVTGPSAQQSFEVRVPEQRDALHLPLSWRVKRPRTSIGGGLPD<br>PGTPTAADLAASSTVMREQDEDPFAGAADDFPAFNEEELAWLMELLPQ |
| SEQ ID NO: 9<br>>gi\|1351732\|sp\|P14727.2\|AVRB3_XANEU RecName: Full = Avirulence protein AvrBs3<br>MDPIRSRTPSPARELLPGPQPDGVQPTADRGVSPPAGGPLDGLPARRTMSRTRLPSPPAPSPAFSAGSFS<br>DLLRQFDPSLFNTSLFDSLPPFGAHHTEAATGEWDEVQSGLRAADAPPPTMRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QDMIAALPEATHEAIVGVGKQWSGARALEALLTVAGELRGPPLQLDTGQLLKIAKRGGVTAVEAVHAWRN<br>ALTGAPLNLTPEQVVAIASHDGGKQALETVQRLLPVLCQAHGLTPQQVVAIASNGGGKQALETVQRLLPV<br>LCQAHGLTPQQVVAIASNSGGKQALETVQRLLPVLCQAHGLTPEQVVAIASNGGGKQALETVQRLLPVLC<br>QAHGLTPEQVVAIASNIGGKQALETVQALLPVLCQAHGLTPEQVVAIASNIGGKQALETVQALLPVLCQA<br>HGLTPEQVVAIASNIGGKQALETVQALLPVLCQAHGLTPEQVVAIASHDGGKQALETVQRLLPVLCQAHG<br>LTPEQVVAIASHDGGKQALETVQRLLPVLCQAHGLTPQQVVAIASNGGGKQALETVQRLLPVLCQAHGLT<br>PEQVVAIASNSGGKQALETVQALLPVLCQAHGLTPEQVVAIASNSGGKQALETVQRLLPVLCQAHGLTPE<br>QVVAIASHDGGKQALETVQRLLPVLCQAHGLTPEQVVAIASHDGGKQALETVQRLLPVLCQAHGLTPEQV<br>VAIASHDGGKQALETVQRLLPVLCQAHGLTPQQVVAIASNGGGRPALETVQRLLPVLCQAHGLTPEQVVA<br>IASHDGGKQALETVQRLLPVLCQAHGLTPQQVVAIASNGGGRPALESIVAQLSRPDPALAALTNDHLVAL<br>ACLGGRPALDAVKKGLPHAPALIKRTNRRIPERTSHRVADHAQVVRVLGFFQCHSHPAQAFDDAMTQFGM<br>SRHGLLQLFRRVGVTELEARSGTLPPASQRWDRILQASGMKRAKPSPTSTQTPDQASLHAFADSLERDLD<br>APSPMHEGDQTRASSRKRSRSDRAVTGPSAQQSFEVRVPEQRDALHLPLSWRVKRPRTSIGGGLPDPGTP<br>TAADLAASSTVMREQDEDPFAGAADDFPAFNEEELAWLMELLPQ |
| SEQ ID NO: 10<br>>gi\|2384736\|gb\|AAB69865.1\| PthN [*Xanthomonas campestris*]<br>MDPIRSRTPSPARELLPGPQPDGVEPTADRGVSPPVGGPLDGLPARRTMSRTRLPSPPAPLPAFSAGSFS<br>DLLRQFDPSLFNTSLFDSMPAVGTPHTEAAPAEWDEVQSALRAADDPPPTVRVAVTAARPPRAKPAPRRR<br>AQPSDASPAAQVDLRTLGYSQQQQEKIKPKARSTVAQHHEALVGHGFTHAHIVALSQHPAALGTVAVTYQ<br>DMIAALPEATHEDIVGVGKQWSGARALEALLTVAGDLRGPPLQLDTGQLLKIAKRGGVTAVEAVHAWRNA<br>LTDAPLNLTPDQVVAIASNIGGKQALETVQRLLPVLCQAHGLTPEQVVAIASHDGGKQALETVQRLLPVL<br>CQAHGLTPDQVVAIASHDGGKQALETVQRLLPVLCQAHGLTPEQVVAIASNIGGKQALETVQRLLPVLCQ<br>AHGLTPDQVVAIASHDGGKQALETVQRLLPVLCQAHGLTPEQVVAIASNIGGKQALETVQRLLPVLCQAH<br>GLTPQQVVAIASNGGGKQALETVQRLLPVLCEQHGLTPDQVVAIASNIGGKQALETVQRLLPVLCEQHGL<br>TPEQVVAIASNNGGKQALETVQRLLPVLCQAHGLTPDQVVAIASHDGGKQALETVQRLLPVLCQAHGLTP<br>DQVVAIASNIGGKQALETVQRLLPVLCQAHGLTPDQVVAIASNGGGRQALETVQRLLPVLCEQHGLTPDQ<br>VVAIASNGGKQALETVQRLLPVLCEQHGLTPAQVVAIASNNGGKQALESIFAQLSRPDPAFAALTNDHLV<br>ALACLGGRPALDAVKKGLPHAPTLIKRTNRRIPERTSHRVADHAHVARVLGFFQCHSHPAQAFDDAMTQF<br>GMSRHGLVQLFRRVGVTELEARSGTLPPASQRWDRILHASGMKRAKPSPTSAQTPDQASLHAFADSLERD |

TABLE 1-continued

Endogenous TALE Polypeptide Sequences

LDAPSPTHEGDQRRASSRKRSRSDRAVTGPSAQQAVEVRVPEQRDALHLPLSWSVKRPRTRIGGGLPDPG
TPLEADLAASSTVMWGQDADPFAGAADDFPAFNEEELAWLRELLPQ

SEQ ID NO: 11
>gi|4163845|dbj|BAA37119.1| ap11 [*Xanthomonas citri*]
MDPIRSRTPSPARELLPGPQPDGVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQRLLPVLCQAHGLTPEQVVAIASNGGKQALETVQRLLPVL
CQAHGLTPEQVVAIASNIGGKQALETVQRLLPVLCQAHGLTPEQVVAIASNIGGKQALETVQRLLPVLCQ
AHGLTPAQVVAIASNIGGKQALETVQRLLPVLCQAHGLTPEQVVAIASHDGGKQALETVQRLLPVLCQAH
GLTPEQVVAIASHDGGKQALETVQRLLPVLCQAHGLTPEQVVAIASNGGGKQALETVQRLLPVLCQAHGL
TPEQVVAIASHDGGKQALETVQRLLPVLCQAHGLTPEQVVAIASNGGGKQALETVQRLLPVLCQAHGLTP
EQVVAIASNGGGKQALETVQRLLPVLCQAHGLTPEQVVAIASNGGGKQALETVQRLLPVLCQAHGLTLDQ
VVAIASNGGGKQALETVQRLLPVLCQAHGLTPEQVVAIASNSGGKQALETVQRLLPVLCQAHGLTPDQVV
AIASHDGGKQALETVQRLLPVLCQAHGLTPEQVVAIASHDGGKQALETVQRLLPVLCQAHGLTPEQVVAI
ACNGGGKQALETVQRLLPVLCQAHGLTPEQVVAIASNGGGRPALESIVAQLSRPDPALAALTNDHLVALA
CLGGRPALDAVKKGLPHAPALIKRTNRRIPERTSHRVADHAQVVRVLGFFQCHSHPAQAFDDAMTQFGMS
RHGLLQLFRRVGVTELEARSGTLPPASQRWDRILQASGMKRAKPSPTSTQTPDQASLHAFADSLERDLDA
PSPTHEGDQRRASSRKRSRSDRAVTGPSAQQSFEVRAPEQRDALHLPLSWRVKRPRTSIGGGLPDPGTPT
AADLAASSTVMREQDEDPFAGAADDFPAFNEEELAWLMELLPQ SEQ ID NO: 12
>gi|4163847|dbj|BAA37120.1| ap12 [*Xanthomonas citri*]
MDPIRSRTPSPARELLPGPQPDGVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQRLLPVLCQAHGLTPEQVVAIASNGGKQALETVQRLLPVL
CQAHGLTPEQVVAIASNIGGKQALETVQRLLPVLCQAHGLTPEQVVAIASHDGGKQALETVQRLLPVLCQ
AHGLTPEQVVAIASNIGGKQALETVQRLLPVLCQAHGLTPEQVVAIASHDGGKQALETVQRLLPVLCQAH
GLTPDQVVAIASHDGGKQALETVQRLLPVLCQAHGLTPQQVVAIASNGGGKQALETVQRLLPVLCQAHGL
TPEQVVAIASHDGGKQALETVQRLLPVLCQAHGLTPEQVVAIASNGGGKQALETVQRLLPVLCQAHGLTP
EQVVAIASNGGGKQALETVQRLLPVLCQAHGLTPEQVVAIASNGGGKQALETVQRLLPVLCQAHGLTLDQ
VVAIASNGGGKQALETVQRLLPVLCQAHGLTPEQVVAIASNIGGKQALETVQRLLPVLCQAHGLTPEQVV
AIASHDGGKQALETVQRLLPVLCQAHGLTPEQVVAIASNGGGRPALESIVAQLSRPDPALAALTNDHLVA
LACLGGRPALDAVKKGLPHAPALIKRTNRRIPERTSHRVADHAQVVRVLGFFQCHSHPAQAFDDAMTQFG
MSRHGLLQLFRRVGVTELEARSGTLPPASQRWDRILQASGMKRAKPSPTSTQTPDQASLHAFADSLERDL
DAPSPTHEGDQRRASSRKRSRSDRAVTGPSAQQSFEVRAPEQRDALHLPLSWRVKRPRTSIGGGLPDPGT
PTAADLAASSTVMREQDEDPFAGAADDFPAFNEEELAWLMELLPQ SEQ ID NO: 13
>gi|4163849|dbj|BAA37121.1|apl3 [*Xanthomonas citri*]
MDPIRSRTPSPARELLPGPQPDGVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQRLLPVLCQAHGLTPEQVVAIASHDGGKQALETVQRLLPV
LCQAHGLTPEQVVAIASNIGGKQALETVQRLLPVLCQAHGLTPEQVVAIASHDGGKQALETVQRLLPVLC
QAHGLTPEQVVAIASNIGGKQALETVQRLLPVLCQAHGLTPEQVVAIASHDGGKQALETVQRLLPVLCQA
HGLTPDQVVAIASHDGGKQALETVQRLLPVLCQAHGLTPQQVVAIASNGGGKQALETVQRLLPVLCQAHG
LTPEQVVAIASHDGGKQALETVQRLLPVLCQAHGLTPEQVVAIASHDGGKQALETVQRLLPVLCQAHGLT
PEQVVAIASNGGKQALETVQRLLPVLCQAHGLTPEQVVAIASNIGGKQALETVQRLLPVLCQAHGLTPEQ
VVAIASHDGGKQALETVQRLLPVLCQAHGLTPEQVVAIASHDGGKQALETVQRLLPVLCQAHGLTPEQVV
AIASNIGGKQALETVQRLLPVLCQAHGLTPEQVVAIASHDGGKQALETVQRLLPVLCQAHGLTPDQVVAI
ASHDGGKQALETVQRLLPVLCQAHGLTPEQVVAIASNGGGKQALETVQRLLPVLCQAHGLTPEQVVAIAS
HDGGKQALETVQRLLPVLCQAHGLTPEQVVAIASNGGGKQALETVQRLLPVLCQAHGLTPEQVVAIASNI
GGKQALETVQRLLPVLCQAHGLTPEQVVAIASHDGGKQALETVQRLLPVLCQAHGLTPEQVVAIACNGGG
KQALETVQRLLPVLCQAHGLTPEQVVAIASNGGGRPALESIVAQLSRPDPALAALTNDHLVALACLGGRP
ALDAVKKGLPHAPALIKRTNRRIPERTSHRVADHAQVVRVLGFFQCHSHPAQAFDDAMTQFGMSRHGLLQ
LFRRVGVTELEARSGTLPPASQRWDRILQASGMKRAKPSPTSTQTPDQASLHAFADSLERDLDAPSPTHE
GDQRRASSRKRSRSDRAVTGPSAQQSFEVRAPEQRDALHLPLSWRVKRPRTSIGGGLPDPGTPTAADLAA
SSTVMREQDEDPFAGAADDFPAFNEEELAWLMELLPQ SEQ ID NO: 14
>gi|9789537|gb|AAF98343.1|avirulence protein [*Xanthomonas oryzae* pv. *oryzae*]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVKY
QHIITALPEATHEDIVGVGKQWSGARALEALLTEARELRGPPLQLDTGQLLKIAKRGGVTAVEAVHAWRN
ALTGAPLNLTPDQVVAIASNIGGKQALETVQRLLPVLCQDHGLTPDQVVAIASHGGGKQALETVQRLLPV
LCQDHGLTPDQVVAIASNIGGKQALETVQRLLPVLCQAHGLTPDQVVAIASNIGGKQALETVQRLLPVLC
QDHGLTPAQVVAIASNSGGKQALETVQRLLPVLCQDHGLTPDQVVAIASHDGGKQALETVQRLLPVLCQD
HGLTPDQVVAIANNNGGKQALETLQRLLPVLCQDHGLTPDQVVAIASHDGGKQALETVQRLLPVLCQDHG
LTPDQVVAIASHDGGKQALETVQRLLPVLCQDHGLTPAQVVAIASHDGGKQALETVQRLLPVLCQDHGLT
PDQVVAIASNSGGKQALETVQRLLPVLCQDHGLTPDQVVAIASNGGKQALETVQRLLPVLCQDHGLTPDQ TABLE 1-continued Endogenous TALE Polypeptide Sequences VVAIASNGGKQALETVQRLLPVQRLLPVLCQDHGLTQDQVVAIASHDGGKQALETVQRLLPVLCQDHGLT
PDQVVAIASHDGGKQALETVQRLLPVLCQDHGLTPDQVVAIASNSGGKQALETVQRLLPVLCQDHGLTPD
QVVAIASNSGGKQALETVQRLLPVLCQDHGLTPDQVVAIASNNGGKQALETVQRLLPVLCQDHGLTPDQV
VAIANNNGGKQALETVQRLLPVLCQDHGLTPAQVVAIASNIGGKQALETVQRLLPVLCQDHGLTLDQVVA
IASNGGSKQALETVQRLLPVLCQDHGLTPDQVVAIANNNGGKQALETVQRLLPVLCQDHGLTPDQVVAIA
SNIGGKQALETVQRLLPVLCQDHGLTLDQVVAIASNGGKQALETVQRLLPVLCQDHGLTPNQVVAIASNS
GGKQALETVQRLLPVLCQDHGLTPNQVVAIASNGGKQALESIVAQLSRPDPALAALTNDHLVALACLGGR
PALDAVKKGLPHAPELIRRINRRIPERTSHRVPDLAHVVRVLGFFQSHSHPAQAFDDAMTQFEMSRHGLV
QLFRRVGVTELEARGGTLPPASQRWDRILQASGMKRAKPSPTSAQTPDQASLHAFADSLERDLDAPSPMH
EGDQTGASSRKRSRSDRAVTGPSAQQSFEVRVPEQRDALHLPLSWRVKRPRTRIGGGLPDPGTPIAADLA
ASSTVMWEQDAAPFAGAADDFPAFNEEELAWLMELLPQSGSVGGTI SEQ ID NO: 15
>gi|13516208|gb|AAG02079.2|AF275317_1 AvrXa7 [*Xanthomonas oryzae* pv. *oryzae*]
HAWRNALTGAPLNLTPDQVVAIASNIGGKQALETVQRLLPVLCQDHGLTPDQVVAIASHGGGKQALETVQ
RLLPVLCQDHGLTPDQVVAIASNIGGKQALETVQRLLPVLCQAHGLTPDQVVAIASNIGGKQALETVQRL
LPVLCQDHGLTPAQVVAIASNSGGKQALETVQRLLPVLCQDHGLTPDQVVAIASHDGGKQALETVQRLLP
VLCQDHGLTPDQVVAIANNNGGKQALETLQRLLPVLCQDHGLTPDQVVAIASHDGGKQALETVQRLLPVL
CQDHGLTPDQVVAIASHDGGKQALETVQRLLPVLCQDHGLTPAQVVAIASHDGGKQALETVQRLLPVLCQ
DHGLTPDQVVAIASNSGGKQALETVQRLLPVLCQDHGLTPDQVVAIASNGGKQALETVQRLLPVLCQDHG
LTPDQVVAIASNGGKQALETVQRLLPVQRLLPVLCQDHGLTQDQVVAIASHDGGKQALETVQRLLPVLCQ
DHGLTPDQVVAIASHDGGKQALETVQRLLPVLCQDHGLTPDQVVAIASNSGGKQALETVQRLLPVLCQDH
GLTPDQVVAIASNNGGKQALETVQRLLPVLFQEHGLTPDQVVAIASNSGGKQALETVQRLLPVLCQDHGL
TPDQVVAIANNNGGKQALETVQRLLPVLCQDHGLTPAQVVAIASNIGGKQALETVQRLLPVLCQDHGLTL
DQVVAIASNGGSKQALETVQRLLPVLCQDHGLTPDQVVAIANNNGGKQALETVQRLLPVLCQDHGLTPDQ
VVAIASNIGGKQALETVQRLLPVLCQDHGLTLDQVVAIASNGGKQALETVQRLLPVLCQDHGLTPNQVVA
IASNSGGKQALETVQRLLPVLCQDHGLTPNQVVAIASNGGKQALESIVAQLSRPDPALAALTNDHLVALA
CLGGSPALDAVKKGLPHAPELIRRINRRIPERTSHRVPDLAHVVRVLGFFQSHSHPAQAFDDAMKQFEMS
RHGLVQLFRRVGVTEFEARYGTLPPASQRWDRILQASGMKRAKPSPTSAQTPDQASLHA SEQ ID NO: 16
>gi|17546534|ref|NP_519936.1|hypothetical protein RSc1815 [*Ralstonia solanacearum* GMI1000]
MRIGKSSGWLNESVSLEYEHVSPPTRPRDTRRRPRAAGDGGLAHLHRRLAVGYAEDTPRTEARSPAPRRP
LPVAPASAPPAPSLVPEPPMPVSLPAVSSPRFSAGSSAAITDPFPSLPPTPVLYAMARELEALSDATWQP
AVPLPAEPPTDARRGNTVFDEASASSPVIASACPQAFASPPRAPRSARARRARTGGDAWPAPTFLSRPSS
SRIGRDVFGKLVALGYSREQIRKLKQESLSEIAKYHTTLTGQGFTHADICRISRRRQSLRVVARNYPELA
AALPELTRAHIVDIARQRSGDLALQALLPVATALTAAPLRLSASQIATVAQYGERPAIQALYRLRRKLTR
APLHLTPQQVVAIASNTGGKRALEAVCVQLPVLRAAPYRLSTEQVVAIASNKGGKQALEAVKAHLLDLLG
APYVLDTEQVVAIASHNGGKQALEAVKADLLDLRGAPYALSTEQVVAIASHNGGKQALEAVKADLLELRG
APYALSTEQVVAIASHNGGKQALEAVKAHLLDLRGVPYALSTEQVVAIASHNGGKQALEAVKAQLLDLRG
APYALSTAQVVAIASNGGGKQALEGIGEQLLKLRTAPYGLSTEQVVAIASHDGGKQALEAVGAQLVALRA
APYALSTEQVVAIASNKGGKQALEAVKAQLLELRGAPYALSTAQVVAIASHDGGNQALEAVGTQLVALRA
APYALSTEQVVAIASHDGGKQALEAVGAQLVALRAAPYALNTEQVVAIASSHGGKQALEAVRALFPDLRA
APYALSTAQLVAIASNPGGKQALEAVRALFRELRAAPYALSTEQVVAIASNHGGKQALEAVRALFRGLRA
APYGLSTAQVVAIASSNGGKQALEAVWALLPVLRATPYDLNTAQIVAIASHDGGKPALEAVWAKLPVLRG
APYALSTAQVVAIACISGGQQALEAIEAHMPTLRQASHSLSPERVAAIACIGGRSAVEAVRQGLPVKAIRR
IRREKAPVAGPPPASLGPTPQELVAVLHFFRAHQQPRQAFVDALAAFQATRPALLRLLSSVGVTEIEALG
GTIPDATERWQRLLGRLGFRPATGAAAPSPDSLQGFAQSLERTLGSPGMAGQSACSPHRKRPAETAIAPR
SIRRSPNNAGQPSEPWPDQLAWLQRRKRTARSHIRADSAASVPANLHLGTRAQFTPDRLRAEPGPIMQAH
TSPASVSFGSHVAFEPGLPDPGTPTSADLASFEAEPFGVGPLDFHLDWLLQILET SEQ ID NO: 17
>gi|21264207|ref|NP_644708.1|avirulence protein [*Xanthomonas axonopodis* pv. *citri* str. 306]
MDPIRSRTPSPARELLPGPQPDGVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVYAWRN
ALTGAPLNLTPEQVVAIASNIGGKQALETVQRLLPVLCQAHGLTPDQVVAIASNGGKQALETVQRLLPVL
CQAHGLTPAQVVAIASNIGGKQALETVQRLLPVLCQAHGLTPAQVVAIASNGGKQALETVQRLLPVLCQA
HGLTPAQVVAIASNIGGKQALETVQRLLPVLCQAHGLTPEQVVAIASHDGGKQALETVQRLLPVLCQAHG
LTPEQVVAIASHDGGKQALETVQRLLPVLCQAHGLTPEQVVAIASNGGKQALETVQRLLPVLCQAHGLTP
AQVVAIASNIGGKQALETVQRLLPVLCQAHGLTPEQVVAIASHDGGKQALETVQRLLPVLCQAHGLTPEQ
VVAIASNIGGKQALETVQRLLPVLCQAHGLTPEQVVAIASHDGGKQALETVQRLLPVLCQAHGLTPEQVV
AIASNGGKQALETVQRLLPVLCQAHGLTPAQVVAIASNIGGKQALETVQRLLPVLCQAHGLTPEQVVAIA
SHDGGKQALETVQRLLPVLCQAHGLTPEQVVAIASHDGGKQALETVQRLLPVLCQAHGLTPEQVVAIASN
GGGRPALESIVAQLSRPDPALAALTNDHLVALACLGGRPALDAVKKGLPHAPALIKRTNRRIPERTSHRV
ADHAQVVRVLGFFQCHSHPAQAFDDAMTQFGMSRHGLLQLFRRVGVTELEARSGTLPPASQRWDRILQAS
GMKRAKPSPTSTQTPDQASLHAFADSLERDLDAPSPTHEGDQRRASSRKRSRSDRAVTGPSAQQSFEVRV
PEQRDALHLPLSWRVKRPRTSIGGGLPDPGTPTAADLAASSTVMREQDEDPFAGAADDFPAFNEEELAWL
MELLPQ TABLE 1-continued Endogenous TALE Polypeptide Sequences SEQ ID NO: 18
>gi|21264224|ref|NP_644725.1|avirulence protein [*Xanthomonas axonopodis* pv. *citri* str. 306]
MDPIRSRTPSPARELLPGPQPDGVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQALLPVLCQAHGLTPEQVVAIASHDGGKQALETVQRLLPV
LCQAHGLTPEQVVAIASNIGGKQALETVQRLLPVLCQAHGLTPEQVVAIASHDGGKQALETVQRLLPVLC
QAHGLTPEQVVAIASNIGGKQALETVQRLLPVLCQAHGLTPDQVVAIASHDGGKQALETVQRLLPVLCQA
HGLTPDQVVAIASHDGGKQALETVQRLLPVLCQAHGLTPQQVVAIASNGGGKQALETVQRLLPVLCQAHG
LTPEQVVAIASHDGGKQALETVQRLLPVLCQAHGLTPEQVVAIASNGGGKQALETVQRLLPVLCQAHGLT
PEQVVAIASNGGGKQALETVQRLLPVLCQAHGLTPEQVVAIASNGGGKQALETVQRLLPVLCQAHGLTLD
QVVAIASNGGGKQALETVQRLLPVLCQAHGLTPEQVVAIASNIGGKQALETVQRLLPVLCQAHGLTPEQV
VAIASNIGGKQALETVQRLLPVLCQAHGLTPEQVVAIASNGGGRPALESIVAQLSRPDPALAALTNDHLV
ALACLGGRPALDAVKKGLPHAPALIKRTNRRIPERTSHRVADHAQVVRVLGFFQCHSHPAQAFDDAMTQF
GMSRHGLLQLFRRVGVTELEARSGTLPPASQRWDRILQASGMKRAKPSPTSTQTPDQASLHAFADSLERD
LDAPSPMHEGDQTRASSRKRSRSDRAVTGPSAQQSFEVRVPEQRDALHLPLSWRVKRPRTSIGGGLPDPG
TPTAADLAASSTVMREQDEDPFAGAADDFPAFNEEELAWLMELLPQ SEQ ID NO: 19
>gi|21264243|ref|NP_644743.1|avirulence protein [*Xanthomonas axonopodis* pv. *citri* str. 306]
MDPIRSRTPSPARELLPGPQPDGVQPTADRGVSPPAGGPLDGLPARRTISRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQALLPVLCQAHGLTPEQVVAIASHDGGKQALETVQRLLPV
LCQAHGLTPEQVVAIASNIGGKQALETVQRLLPVLCQAHGLTPEQVVAIASHDGGKQALETVQRLLPVLC
QAHGLTPEQVVAIASNIGGKQALETVQRLLPVLCQAHGLTPEQVVAIASNGGGKQALETVQRLLPVLCQA
HGLTPEQVVAIASHDGGKQALETVQRLLPVLCQAHGLTPDQVVAIASNGGGKQALETVQRLLPVLCQAHG
LTPDQVVAIASNGGGKQALETVQRLLPVLCQAHGLTPDQVVAIASNGGGKQALETVQRLLPVLCQAHGLT
PDQVVAIASNIGGKQALETVQRLLPVLCQAHGLTPEQVVAIASNIGGKQALETVQRLLPVLCQAHGLTPE
QVVAIASNIGGKQALETVQRLLPVLCQAHGLTPEQVVAIASNIGGKQALETVQRLLPVLCQAHGLTPEQV
VAIASHDGGKQALETVQRLLPVLCQAHGLTPEQVVAIASNGGGRPALESIVAQLSRPDPALAALTNDHLV
ALACLGGRPALDAVKKGLPHAPALIKRTNRRIPERTSHRVADHAQVVRVLGFFQCHSHPAQAFDDAMTQF
GMSRHGLLQLFRRVGVTELEARSGTLPPASQRWDRILQASGMKRAKPSPTSTQTPDQASLHAFADSLERD
LDAPSPTHEGDQRRASSRKRSRSDRAVTGPSAQQSFEVRVPEQRDALHLPLSWRVKRPRTSIGGGLPDPG
TPTAADLAASSTVMREQDEDPFAGAADDFPAFNEEELAWLMELLPQ SEQ ID NO: 20
>gi|21264293|ref|NP_644793.1|avirulence protein [*Xanthomonas axonopodis* pv. *citri* str. 306]
MDPIRSRTPSPARELLPGPQPDGVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQRLLPVLCQAHGLTPEQVVAIASNGGKQALETVQRLLPVL
CQAHGLTPEQVVAIASNIGGKQALETVQRLLPVLCQAHGLTPEQVVAIASNIGGKQALETVQRLLPVLCQ
AHGLTPAQVVAIASNIGGKQALETVQRLLPVLCQAHGLTPEQVVAIASHDGGKQALETVQRLLPVLCQAH
GLTPDQVVAIASHDGGKQALETVQRLLPVLCQAHGLTPEQVVAIASNGGGKQALETVQRLLPVLCQAHGL
TPEQVVAIASHDGGKQALETVQRLLPVLCQAHGLTPEQVVAIASNGGGKQALETVQRLLPVLCQAHGLTP
EQVVAIASNGGGKQALETVQRLLPVLCQAHGLTPEQVVAIASNGGGKQALETVQRLLPVLCQAHGLTLDQ
VVAIASNGGGKQALETVQRLLPVLCQAHGLTPEQVVAIASNSGGKQALETVQRLLPVLCQAHGLTPDQVV
AIASHDGGKQALETVQRLLPVLCQAHGLTPEQVVAIASHDGGKQALETVQRLLPVLCQAHGLTPEQVVAI
ACNGGGKQALETVQRLLPVLCQAHGLTPEQVVAIASNGGGRPALESIVAQLSRPDPALAALTNDHLVALA
CLGGRPALDAVKKGLPHAPALIKRTNRRIPERTSHRVADHAQVVRVLGFFQCHSHPAQAFDDAMTQFGMS
RHGLLQLFRRVGVTELEARSGTLPPASQRWDRILQASGMKRAKPSPTSTQTPDQASLHAFADSLERDLDA
PSPTHEGDQRRASSRKRSRSDRAVTGPSAQQSFEVRVPEQRDALHLPLSWRVKRPRTSIGGGLPDPGTPT
AADLAASSTVMREQDEDPFAGAADDFPAFNEEELAWLMELLPQ SEQ ID NO: 21
>gi|22658444|gb|AAN01357.1|avirulence protein [*Xanthomonas oryzae* pv. *oryzae*]
MRPGKLCRDHRPLVWRRPCKEVCLMDPIRSRTPSPARELLPGPQPDRVQPTADRGGAPPAGGPLDGLPAR
RTMSRTRLPSPPAPSPAFSAGSFSDLLRQFDPSLLDTSLLDSMPAVGTPHTAAAPAEWDEAQSGLRAADD
PPPTVRVAVTAARPPRAKPAPRRRAAQPSDASPAAQVDLRTLGYSQQQQEKIKPKVRSTVARHHEALVGH
GFTHAHIVALSQHPAALGTVAVTYQDIIRALPEATHEDIVGVGKQWSGARALEALLTEAGELRGPPLQLD
TGQLLKIAKRGGVTAVKAVHAWRNALTGAPLNLTPAQVVAIASHDGGNQALETVQRLLPVLCQDHGLTPA
QVVAIASHDGGKQALETVQRLLPVLCQDHGLTPDQVVAIASHDGGKQALETVQRLLPVLCQDHGLTPAQA
VAIASNGGGKQALETVQRLLPVLCQDHGLTPDQVVAIASNGGKQALETVQRLLPVLCQDHGLTPDQVVAI
ASNNGGKQALETVQRLLPVLCQDHGLTPDQVVAIASHDGGKQALETVQRLLPVLCQDHGLTPDQVVAIAS
HDGGKQALETVQRLLPVLCQDHGLTPDQVVAIASNGGGKQALESIVAQLSRPDPALAALTNDHLVALACL
GGRPALDAVKKGLPHAPELIRRVNRRIGERTSHRVADYAQVVRVLEFFQCHSHPAQAFDDAMTQFGMSRH
GLVQLFRRVGVTEFEARCGTLPPASQRWDRILQASGMKRAKPSPTSAQTPDQASLHAFADSLERDLDAPS
PMHEGDQTRASSRKRSRSDRAVTGPSTQQSFEVRVPEQRDALHLPLSWRVKRPRTRIGGGLPDPGTPIAA
DLAASSTVMWEQDAAPFAGAADDFPAFNEEELAWLMELLPQSGSVGGTI TABLE 1-continued Endogenous TALE Polypeptide Sequences SEQ ID NO: 22
>gi|35395760|gb|AAQ79773.2|putative avirulence protein Avrxa5 [*Xanthomonas oryzae* pv. *oryzae*]
MDPIRSRTPSPAREPLPGPQPDRVQPTADRGVSAPAGSPLDGLPARRTVSRTRLPSPPAPLPAFSAGSST
DRLRQFDPSLPDTSLFDSMPAVGTPHTEAAPADTSPAAQVDLLTLATVAQHHEALVGHGFTHAHIVALSQ
HPAALGTVAVTYQDIITALPEATHEDIVGVGKQLSGARALEALLTKAGELRGPPLQLDTGQLLKIARRGG
VTAVEAVHAWRNALTGAPLNLTPDQVVAIASNSGGKQALETVQRLLPVLCQDHGLTPDQVVAIASHDGGK
QALETVQRLLPVLCQDHGLTPDQVVAIASNIGGKQALETVQRLLPVLCQDHGLTPDQVVAIASNIGGKQA
LETVQRLLPVLCQDHGLTPDQVVAIASNIGGKQALETVQRLLPVLCQDHGLTPDQVVAIASNGGKQALES
IVAQLSRPDPALAALTNDHLVALACLGGRPALDAVKKGLPHAPELIRRVNSRIGERTSHRVADLAHVVRV
LGFFQSHSHPAQAFDDAMTQFGMSRHGLVQLFRRVGVTEFEARCGTIPPASQRWDRILQASGTKRAKPSP
TSAQTPDQASLHAFPDSLERDLDAPSPMHEGDQTRASRRKRSRSDRAVTDPSAQQSFEVRVPEQHDALHL
PLSWRVKRPRTRIGGGLPDPGTPMVADLAASSTVMWEQDAAPFAGAADDFPAFNEEELAWLMELLPQSGS
VGGTI SEQ ID NO: 23
>gi|38639488|ref|NP_942641.1|PthB [*Xanthomonas citri*]
MDPIRPRTSSPAHELLAGPQPDRVQPQPTADRGGAPPAGSPLDGLPARRTMSRTRLPSPPAPLPAFSAGS
FSDLLCQFDPLLLDTLLFDSMSAFGAPHTEAAPGEADEVQSGLRAVDDPHPTVHVAVTAARPPRAKPAPR
RRAAHTSDASPAGQVDLCTLGYSQQQQDEIKPKARATVAQHHQALMGHGFTRAHIVALSQHPAALGTVAV
KYQAMIAALPEATHEDIVGVGKQWSGARALEALLTVSGELRGPPLQLDTGQLLKIAKRGGVTAVEAVHAW
RNALTGAPLNLTPDQVVAIASHDGGKQALETVQRLLPVLCEQHGLTPAQVVAIASNGGGKQALETVQQLL
PVLCEQHGLTPDQVVAIASHDGGKQALETVQRLLPVLCEQHGLTPAQVVAIASNGGGKQALETVQQLLPV
LCEQHGLTPDQVVAIASNIGGKQALETVQRLLPVLCEQHGLTPAQVVAIASNGGGKQALETVQQLLPVLC
EQHGLTPDQVVAIASHDGGKQALETVQRLLPVLCEQHGLTPAQVVAIASNGGGKQALKTVQQLLPVLCEQ
HGLTPDQVVAIASHDGGKQALETVQRLLPVLCEQHGLTPDQVVAIASNIGGKQALETVQRLLPVLCEQHG
LTPDQVVAIASNIGGKQALETVQRLLPVLCEQHGLTPDQVVAIASHDGGKQALETVQRLLPVLCEQHGLT
PDQVVAIASHDGGKQALETVQRLLPVLCEQHGLTPDQVVAIASHDGGKQALETVQRLLPVLCEQHGLTPD
QVVAIASHDGGKQALETVQRLLPVLCEQHGLTPDQVVAIASNGGGKQALETVQRLLPVLCEQHGLTPDQV
VAIASNGGGKQALETVQRLLPVLRQAHGLTPAQVVAIASNGGGRPALESIFAQLSRPDQALAALTNDHLV
ALACLGGRPALEAVKKGLPHAPTLIKRTNRRLPERTSHRVADHAQVARVLGFFQCHSHPAQAFDEAMTQF
GMSRHGLLQLFRRVGVTELEARGGTLPPAPQRWHRILQASGMKRAEPSGASAQTPDQASLHAFADALERE
LDAPSPIDQAGQALASSSRKRSRSESSVTGSFAQQAVEVRVPEQRDALHLPPLSWGVKRPRTRIGGGLPD
PGTPMDADLAASSTVMWEQDADPFAGAADDFPAFNEEEMAWLMELFPQ SEQ ID NO: 24
>gi|42795397|gb|AAS46025.1|PthXo1 [*Xanthomonas oryzae* pv. *oryzae*]
HASRNALTGAPLNLTPAQVVAIASNNGGKQALETVQRLLPVLCQAHGLTPAQVVAIASHDGGKQALETMQ
RLLPVLCQAHGLTPDQVVAIASNIGGKQALETVQRLLPVLCQAHGLTPDQVVAIASHGGGKQALETVQRL
LPVLCQAHGLTPDQVVAIASHDGGKQALETVQRLLPVLCQAHGLTPDQVVAIASNGGGKQALETVQRLLP
VLCQAHGLTPDQVVAIASNGGKQALETVQRLLPVLCQAHGLTPDQVVAIASHDGGKQALETVQRLLPVLC
QTHGLTPAQVVAIASHDGGKQALETVQQLLPVLCQAHGLTPDQVVAIASNIGGKQALATVQRLLPVLCQA
HGLTPDQVVAIASNGGGKQALETVQRLLPVLCQAHGLTPDQVVAIASNGGGKQALETVQRLLPVLCQAHG
LTQVQVVAIASNIGGKQALETVQRLLPVLCQAHGLTPAQVVAIASHDGGKQALETVQRLLPVLCQAHGLT
PDQVVAIASNGGGKQALETVQRLLPVLCQAHGLTQEQVVAIASNNGGKQALETVQRLLPVLCQAHGLTPD
QVVAIASNGGGKQALETVQRLLPVLCQAHGLTPAQVVAIASNIGGKQALETVQRLLPVLCQDHGLTLAQV
VAIASNIGGKQALETVQRLLPVLCQAHGLTQDQVVAIASNIGGKQALETVQRLLPVLCQDHGLTPDQVVA
IASNIGGKQALETVQRLLPVLCQDHGLTLDQVVAIASNGGKQALETVQRLLPVLCQDHGLTPDQVVAIAS
NSGGKQALETVQRLLPVLCQDHGLTPNQVVAIASNGGKQALESIVAQLSRPDPALAALTNDHLVALACLG
GRPALDAVKKGLPHAPELIRRINRRIPERTSHRVPDLAHVVRVLGFFQSHSHPAQAFDDAMTQFGMSRHG
LVQLFRRVGVTEFEARYGTLPPASQRWDRILQASGMKRAKPSPTSAQTPDQASLHA SEQ ID NO: 25
>gi|42795399|gb|AAS46026.1|PthXo2 [*Xanthomonas oryzae* pv. *oryzae*]
HAWRNALTGAPLNLTPDQVVAIASNIGGKQALETVQRLLPVLCQAHGLTPDQVVAIASHGGGKQALETVQ
RLLPVLCQDHGLTPAQVVAIASNIGGKQALETVQRLLPVLCQDHGLTPDQVMAIANNNGGKQALETVQRL
LPVLCQDHGLTPDQVMAIANNNGGKQALETVQRLLPVLCQDHGLTPDQVVAIASNIGGKQALETVQRLLP
VLCQDHGLTPTQVMAIANNNGGKQALETVQRLLPVLCQDHGLTPDQVVAIASHDGGKQALETVQRLLPVL
CQDHGLTPAQVVAIASNIGGKQALETVQRLLPVLCQDHGLTPDQVVAIASHDGGKQALETVQRLLPVLCQ
DHGLTPDQVVAIASNSGGKQALETVQRLLPVLCQDHGLTPDQVVAIASNSGGKQALETVQRLLPVLCQDH
GLTPAQVVAIASNSGGKQALETVQRLLPVLCQDHGLTPDQVVAIASHDGGKQALETVQRLLPVLCQDHGL
TPDQVVAIANNNGGKQALETLQRLLPVLCQDHGLTPDQVVAIASHDGGKQALETVQRLLPVLCQDHGLTP
DQVVAIASNGGGKQALETVQRLLPVLCQDHGLTPDQVVAIASHDGGKQALETVQRLLPVLCQDHGLTPAQ
VVAIASHDGGKQALETVQRLLPVLCQDHGLTPDQVVAIASHDGGKQALETVQRLLPVLCQDHGLTPDQVV
AIASNGGGKQALKTVQRLLPVLCQDHGLTPDQVVAIASNGGGKQALESIVAQLSCPDPALAALTNDHLVA
LACLGGRPALDAVKKGLPHAPELIRRINRRIPERTSHRVADLAHVVRVLGFFQSHSHPAQAFDDAMTQFG
MSRHGLVQLFRRVGVTEFEARYGTLPPASQRWDRILQASGMKRAKPSPTSAQTPDQASLHA SEQ ID NO: 26
>gi|42795401|gb|AAS46027.1|PthXo3 [*Xanthomonas oryzae* pv. *oryzae*]
HAWRNALTGAPLNLTPDQVVAIASNIGGKQALETVQRLLPVLCQANGLTPDQVVAIASHGGGKQALETVQ
RLLPVLCQDHGLTPDQVVAIASNIGGKQALETVQRLLPVLCQDHGLTPDQVVAIASHGGGKQALETVQRL
LPVLCQDHGLTPDQVVAIASNIGGKQALETVQRLLPVLCQAHGLTPDQVVAIASNIGGKQALETVQRLLP
VLCQDHGLTPAQVVAIASNIGGKQALETVQRLLPVLCQDHGLTPDQVVAIASHDGGKQALETVQRLLPVL
CQDHGLTPDQVVAIANNNGGKQALETVQRLLPVLCQDHGLTPDQVVAIASHDGGKQALETVQRLLPVLCQ
DHGLTPDQVVAIASHDGGKQALETVQRLLPVLCQDHGLTPAQVVAIASHDGGKQALETVQRLLPVLCQDH
GLTPDQVVAIASNGGGKQALATVQRLLPVLCQAHGLTPDQVVAIASHDGGKQALETVQRLLPVLCQANGL TABLE 1-continued Endogenous TALE Polypeptide Sequences TPDQVVAIASNGGKQALETVQRLLPVQRLLPVLCQDHGLTQDQVVAIASNIGGKQALETVQRLLPVLCQA
NGLTQDQVVAIASHDGGKQALETVQRLLPVLCQDHGLTPDQVVAIASHDGGKQALETVQRLLPVLCQDHG
LTPAQVVAIANNNGGKQALETVQRLLPVLCQDHGLTPDQVVAIASNSGGKQALETVQRLLPVLCQDHGLT
PDQVVAIASNIGGKQALATVQRLLPVLCQDHGLTPDQVVAIANNNGGKQALETVQRLLPVLCQDHGLTPA
QVVAIASNNGGKQALETVQRLLPVLCQDHGLTLDQVVAIASNGGSKQALETVQRLLPVLCQDHGLTPDQV
VAIANNNGGKQALETVQRLLPVLCQDHGLTLDQVVAIASHDGGKQALETVQRLLPVLCQDHGLTLDQVVA
IASNGGKQALETVQRLLPVLCQDHGLTPNQVVAIASNSGGKQALETVQRLLPVLCQDHGLTPNQVVAIAS
NGGKQALESIVAQLSRPDPALAALTNDHLVALACLGGRPALDAVKKGLPHAPELIRRINRRIPERTSHRV
PDLAHVVRVLGFFQSHSHPAQAFDDAMTQFEMSRHGLVQLFRRVGVTEFEARYGTLPPASQRWDRILQAS
GMKRAKPSPTSAQTPDQASLHA SEQ ID NO: 27
>gi|45655429|gb|AAS75145.1|avirulence/virulence protein [*Xanthomonas oryzae* pv. *oryzae*]
DPIRSRTPSPARELLPGPQPDRVQPTADRGGAPPAGGPLDGLPARRTMSRTRLPSPPAPSPAFSAGSFSD
LLRQFDPSLLDTSLLDSMPAVGTPHTAAAPAEWDEVQSGLRAADDPPPTVRVAVTAARPPRAKPAPRRRA
AQPSDASPAAQVDLRTLGYSQQQQEKIKPKVRSTVAQHHEALVGHGFTHAHIVALSQHPAALGTVAVKYQ
HIITALPEATHEDIVGVGKQWSGARALEALLTKAGELRGPPLQLDTGQLLKIAKRGGVTAVEAVHAWRNA
LTGAPLNLTPDQVVAIASNIGGKQALETVQRLLPVLCQDHGLTPDQVVAIASHGGGKQALETVQRLLPVL
CQDHGLTPDQVVAIASNIGGKQALETVQRLLPVLCQAHGLTPDQVVAIASNIGGKQALETVQRLLPVLCQ
DHGLTPAQVVAIASNSGGKQALETVQRLLPVLCQDHGLTPDQVVAIASHDGGKQALETLQRLLPVLCQDH
GLTPDQVVAIANNNGGKQALETLQRLLPVLCQDHGLTPDQVVAIASHDGGKQALETVQRLLPVLCQDHGL
TPDQVVAIASHDGGKQALETVQRLLPVLCQDHGLTPAQVVAIASHDGGKQALETVQRLLPVLCQDHGLTP
DQVVAIASNSGGKQALETVQRLLPVLCQDHGLTPDQVVAIASNGGKQALETVQRLLPVLCQDHGLTPDQV
VAIASNGGKQALETVQRLLPVQRLLPVLCQDHGLTQDQVVAIASHDGGKQALETVQRLLPVLCQDHGLTP
DQVVAIASHDGGKQALETVQRLLPVLCQDHGLTPDQVVAIASNSGGKQALETVQRLLPVLCQDHGLTPDQ
VVAIASNSGGKQALETVQRLLPVLCQDHGLTPDQVVAIASNNGGKQALETVQRLLPVLCQDHGLTPDQVV
AIANNNGGKQALETVQRLLPVLCQDHGLTPAQVVAIASNIGGKQALETVQRLLPVLCQDHGLTLDQVVAI
ASNGGSKQALETVQRLLPVLCQDHGLTPDQVVAIANNNGGKQALETVQRLLPVLCQDHGLTPDQVVAIAS
NIGGKQALETVQRLLPVLCQDHGLTLDQVVAIASNGGKQALETVQRLLPVLCQDHGLTPNQVVAIASNSG
GKQALETVQRLLPVLCQDHGLTPNQVVAIASNGGKQALESIVAQLSRPDPALAALTNDHLVALACLGGRP
ALDAVKKGLPHAPELIRRINRRIPERTSHRVPDLAHVVRVLGFFQSHSHPAQAFDDAMTQFEMSRHGLVQ
LFRRVGVTEFEARYGTLPPASQRWDRILQASGMKRAKPSPTSAQTPDQASLHAFADSLERDLDAPSPMHE
GDQTGASSRKRSRSDRAVTGPSAQQSFEVRVPEQRDALHLPLSWRVKRPRTRIGGGLPDP SEQ ID NO: 28
>gi|48727685|gb|AAT46122.1|avirulence protein AvrXa7-1M [*Xanthomonas oryzae* pv. *oryzae*]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVKY
QHIITALPEATHEDIVGVGKQWSGARALEALLTEARELRGPPLQLDTGQLLKIAKRGGVTAVEAVHAWRN
ALTGAPLNLTPDQVVAIASNIGGKQALETVQRLLPVLCQDHGLTPDQVVAIASHGGGKQALETVQRLLPV
LCQDHGLTPDQVVAIASNIGGKQALETVQRLLPVLCQAHGLTPDQVVAIASNIGGKQALETVQRLLPVLC
QDHGLTPAQVVAIASNSGGKQALETVQRLLPVLCQDHGLTPDQVVAIASHDGGKQALETVQRLLPVLCQD
HGLTPDQVVAIANNNGGKQALETLQRLLPVLCQDHGLTPDQVVAIASHDGGKQALETVQRLLPVLCQDHG
LTPDQVVAIASHDGGKQALETVQRLLPVLCQDHGLTPAQVVAIASHDGGKQALETVQRLLPVLCQDHGLT
PDQVVAIASNSGGKQALETVQRLLPVLCQDHGLTPDQVVAIASNGGKQALETVQRLLPVLCQDHGLTPDQ
VVAIASNGGKQALETVQRLLPVQRLLPVLCQDHGLTQDQVVAIASHDGGKQALETVQRLLPVLCQDHGLT
PDQVVAIASHDGGKQALETVQRLLPVLCQDHGLTPDQVVAIASNSGGKQALETVQRLLPVLCQDHGLTPD
QVVAIASNSGGKQALETVQRLLPVLCQDHGLTPDQVVAIASNNGGKQALETVQRLLPVLCQDHGLTPDQV
VAIANNNGGKQALETVQRLLPVLCQDHGLTPAQVVAIASNIGGKQALETVQRLLPVLCQDHGLTLDQVVA
IASNGGSKQALETVQRLLPVLCQDHGLTPDQVVAIANNNGGKQALETVQRLLPVLCQDHGLTPDQVVAIA
SNIGGKQALETVQRLLPVLCQDHGLTLDQVVAIASNGGKQALETVQRLLPVLCQDHGLTPNQVVAIASNS
GGKQALETVQRLLPVLCQDHGLTPNQVVAIASNGGKQALESIVAQLSRPDPALAALTNDHLVALACLGGR
PALDAVKKGLPHAPELIRRINRRIPERTSHRVPDLAHVVRVLGFFQSHSHPAQAFDDAMTQFEMSRHGLV
QLFRRVGVTEFEARYGTLPPASQRWDRILQASGMKRAKPSPTSAQTPDQASLHAFADSLERDLDAPSPMH
EGDQTGASSRKRSRSDRAVTGPSAQQSFEVRVPEQRDALHLPLSWRVKRPRTRIGGGLPDPGTPIAADLA
ASSTVLWEQDAAPFAGAADDFPAFNEEELAWLMELLPQSGSVGGTI SEQ ID NO: 29
>gi|48727687|gb|AAT46123.1|avirulence protein AvrXa7-2M [*Xanthomonas oryzae* pv. *oryzae*]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAECDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVTY
QDIIRALPEATHEDIVGVGKQWSGARALEALLTEARELRGPPLQLDTGQLLKIAKRGGVTAVEAVHAWRN
ALTGAPLNLTPDQVVAIASNIGGNQALETVQRLLPVLCQDHGLTPDQVVAIASHGGKQALETVQRLLPVL
CQDHGLTPDQVVAIASNIGGKQALETVQRLLPVLCQAHGLTPAQVVAIASNNGGKQALETVQRLLPVLCQ
AHGLTPDQVVAIASNNGGKQALETVQRLLPVLCQAHGLTPDQVVAIANNNGGKQALETVQRLLPVLCQDH
GLSPDQVVAIANNNGGKQALETLQRLLPVLCQTHALTPDQVVAIANNNGGKQALETVQRLLPVLCQDHGL
TPDQVVAIASHDGGKQALETVQRLLPVLCQDHGLTPDQVVAIASNIGGKQALETVQRLLPVLCQDHGLTP
DQVVAIASNSGGKQALETVQRLLPVLCQDHGLTPDQVVAIASHGGGKQALETVQRLLPVLCQDHGLTPDQ
VVAIASHDGGKQALETVQRLLPVLCQAHGLTPNQVVAIASNIGGKQALETVQRLLPVLCQDHGLTPDQVV
AIASNGGKQALETVQRLLPVLCQAHGLTPDQVVAIASNSGGKQALETVQRLLPVLCQDHGLTPNQVVAIA
SNIGGKQALETVQRLLPVLCQDHGLTPDQVVAIASNIGGKQALETVQRLLPVLCQAHGLTLDQVVAIASH
DGGKQALETVQRLLPVLCQAHGLTPDQVVAIASHDGGKQALETVQRLLPVLCQAHGLTLDKVVAIASNGG
KQALETVQRLLPVLCQDHGLTPNQVVAIASNSGGKQALETVQRLLPVLCQDHGLTPNQVVAIASNGGKQA TABLE 1-continued

| Endogenous TALE Polypeptide Sequences |
|---|
| LESIVAQLSRPDPALAALTNDHLVALACLGGRPALDAVKKGLPHAPELIRRINRRIPERTSHRVPDLAHV VRVLGFFQSHSHPAQAFDDAMTQFEMSRHGLVQLFRRVGVTEFEARYGTLPPASQRWDRILQASGMKRAK PSPTSAQTPDQASLHAFADSLERDLDAPSPMHEGDQTGASSRKRSRSDRAVTGPSAQQSFEVRVPEQRDA LHLPLSWRVKRPRTRIGGGLPDPGTPIAADLAASSTVMWEQDAAPFAGAADDFPAFNEEELAWLMELLPQ SGSVGGTI |
| SEQ ID NO: 30<br>>gi\|48727689\|gb\|AAT46124.1\|avirulence protein AvrXa7-3M [*Xanthomonas oryzae* pv. *oryzae*]<br>MDPIRSRTPSPARELLPGPQPDRVQPTADRGGAPPAGGPLDGLPARRTMSRTRLPSPPAPSPAFSAGSFS DLLRQFDPSLLDTSLLDSMPAVGTPHTAAAPAEWDEVQSGLRAADDPPPTVRVAVTAARPPRAKPAPRRR AAQPSDASPAAQVDLRTLGYSQQQQEKIKPKVRSTVAQHHEALVGHGFTHAHIVALSQHPAALGTVAVTY QDIIRALPEATHEDIVGVGKQWSGARALEALLTEAGELRGPPLQLDTGQLLKIAKRGGVTAVEAVHAWRN ALTGAPLNLTPDQVVAIASNIGGKQALETVQRLLPVLCQDHGLTPDQVVAIASHGGGKQALETVQRLLPV LCQDHGLTPDQVVAIASNIGGKQALETVQRLLPVLCQDHGLTPDQVVAIASNIGGKQALETVQRLLPVLC QDHGLTPDQVVAIASHGGGKQALETVQRLLPVLCQAHGLTPDQVVAIARHDGGKQALETVQRLLPVLCQA HGLTPDQVVAIANNNGGKQALETVQRLLPVLCQAHGLTPDQVVAIASHDGGKQALETVQRLLPVLCQAHG LTPDQVVAIASHDGGKQALETVQRLLPVLCQDHGLTPDQVVAIASHDGGKQALETVQRLLPVLCQDHGLT PDQVVAIASNIGGKQALETVQRLLPVLCQDHGLTPDQVVAIASNIGGKQALETVQRLLPVLCQDHGLTPD QVVAIANNNGGKQALETVQRLLPVQRLVPVLCQDHGLTQDQVVAIASNIGGKQALETVQRLLPVLYQDHG LTQDQVVAIASHDGGKQALETVQRLLPVLCQDHGLTPDQVVAIASHDGGKQALETVQRLLPVLCQEHGLT PDQVVAIASHDGGKQALETVQRLLPVLCQDHGLTPDQVVAIASHGGGKQALGTVQRLLPVLCQDHGLTPD QVVAIANNNGGKQALETVQRLLPVLCQDHGLTPDQVVAIANNNGGKQALETVQRLLPVLCQAHGLTPDQV VAIASHDGGKQALETVQRLLPVLCQDHGLTPAQVVAIASNSGGKQALETVQRLLPVLCQDHGLTPAQVVA IANNNGGKQALETVQRLLPVLCQDHGLTPDQVVAIASHDGGKQALETVQRLLPVLCQDHGLTPDQVVAIA SNGGGKQALATVQRLLPVLCQAHGLTPDQVVAIASNSGGKQALETVQRLLPVLCQDHGLTPNQVVAIASN GGKQALESIVAQLSRPDPALAALTNDHLVALACLGGRPALDAVKKGLPHAPELIRRINRRIPERTSHRVP DLAHVVRVLGFFQSHSHPAQAFDDAMTQFGMSRHGLVQLFRRVGVTEFEARYGTLPPASQRWDRILQASG MKRAKPSPTSAQTPDQASLHAFADSLERDLDAPSPMHEGDQTGASSRKRSRSDRAVTGPSAQQSFEVRVP EQRDALHLPLSWRVKRPRTRIGGGLPDPGTPIAADLAASSTVMWEQDAAPFAGAADDFPAFNEEELAWLM ELLPQSGSVGGTI |
| SEQ ID NO: 31<br>>gi\|48727691\|gb\|AAT46125.1\|avirulence protein AvrXa7-4M [*Xanthomonas oryzae* pv. *oryzae*]<br>MDPIRSRTPSPARELLPGPQPDRVQPTADRGGAPPAGGPLDGLPARRTMSRTRLPSPPAPSPAFSAGSFS DLLRQFDPSLLDTSLLDSMPAVGTPHTAAAPAEWDEVQSGLRAADDPPPTVRVAVTAARPPRAKPAPRRR AAQPSDASPAAQVDLRTLGYSQQQQEKIKPKVRSTVAQHHEALVGHGFTHAHIVALSQHPAALGTVAVTY QDIIRALPEATHEDIVGVGKQWSGARALEALLTEAGELRGPPLQLDTGQLLKIAKRGGVTAVEAVHAWRN ALTGAPLNLTPDQVVAIASNIGGKQALETVQRLLPVLCQDHGLTPDQVVAIASHGGGKQALETVQRLLPV LCQDHGLTPDQVVAIASNIGGKQALETVQRLLPVLCQAHGLTPDQVVAIASNIGGKQALETVQRLLPVLC QDHGLTPAQVVAIASNSGGKQALETVQRLLPVLCQDHGLTPDQVVAIASHDGGKQALETVQRLLPVLCQD HGLTPDQVVAIANNNGGKQALETLQRLLPVLCQDHGLTPDQVVAIASHDGGKQALETVQRLLPVLCQDHG LTPDQVVAIASHDGGKQALETVQRLLPVLCQDHGLTPAQVVAIASHDGGKQALETVQRLLPVLCQDHGLT PDQVVAIASNSGGKQALETVQRLLPVLCQDHGLTPDQVVAIASNGGKQALETVQRLLPVLCQDHGLTPDQ VVAIASNGGKQALETVQRLLPVQRLLPVLCQDHGLTQDQVVAIASHDGGKQALETVQRLLPVLCQDHGLT PDQVVAIASHDGGKQALETVQRLLPVLCQDHGLTPDQVVAIASNSGGKQALETVQRLLPVLCQDHGLTPD QVVAIASNSGGKQALETVQRLLPVLCQDHGLTPDQVVAIASNNGGKQALETVQRLLPVLCQDHGLTPDQV VAIANNNGGKQALETVQRLLPVLCQDHGLTPAQVVAIASNIGGKQALETVQRLLPVLCQDHGLTLDQVVA IASNGGSKQALETVQRLLPVLCQDHGLTPDQVVAIANNNGGKQALETVQRLLPVLCQDHGLTPDQVVAIA SNIGGKQALETVQRLLPVLCQDHGLTLDQVVAIASNGGKQALETVQRLLPVLCQDHGLTPDQVVAIASNS GGKQALETVQRLLPVLCQDHGLTPNQVVAIASNGGKQALESIVAQLSRPDPALAALTNDHLVALACLGGR PALDAVKKGLPHAPELIRRINRRIPERTSHRVPDLAHVVRVLGFFQSHSHPAQAFDDAMTQFGMSRHGLV QLFRRVGVTEFEARYGTLPPASQRWDRILQASGMKRAKPSPTSAQTPDQASLHAFADSLERDLDAPSPMH EGDQTGASSRKRSRSDRAVTGPSAQQSFEVRVPEQRDALHLPLSWRVKRPRTRIGGGLPDPGTPIAADLA ASSTVMWEQDAAPFAGAADDFPAFNEEELAWLMELLPQSGSVGGTI |
| SEQ ID NO: 32<br>>gi\|50299523\|gb\|AAS58127.2\|avirulence protein PthXo4 [*Xanthomonas oryzae* pv. *oryzae*]<br>HAWRNALTGAPLNLTPDQVVAIASNIGGKQALETVQRLLPVLCQDHGLTPDQVVAIASHGGGKQALETVQ RLLPVLCQDHGLTPDQVVAIASNIGGKQALETVQRLLPVLCQAHGLTPDQVVAIASNIGGKQALETVQRL LPVLCQDHGLTPAQVVAIASNSGGKQALETVQRLLPVLCQDHGLTPDQVVAIASHDGGKQALETVQRLLP VLCQDHGLTPDQVVAIANNNGGKQALETLQRLLPVLCQDHGLTPDQVVAIASNIGGKQALETVQRLLPVL CQDHGLTLDQVVAIASNGGSKQALETVQRLLPVLCQDHGLTPDQVVAIANNNGGKQALETVQRLLPVLCQ DHGLTPDQVVAIASNIGGKQALETVQRLLPVLCQDHGLTLDQVVAIASNGGKQALETVQRLLPVLCQDHG LTPNQVVAIASNSGGKQALETVQRLLPVLCQDHGLTPNQVVAIASNGGKQALESIVAQLSRPDPALAALT NDHLVALACLGGSPALDAVKKGLPHAPELIRRINRRIPERTSHRVPDLAHVVRVLGFFQSHSHPAQAFDD AMKQFEMSRHGLVQLFRRVGVTEFEARYGTLPPASQRWDRILQASGMKRAKPSPTSAQTPDQASLHA |
| SEQ ID NO: 33<br>>gi\|50299525\|gb\|AAS58128.2\|avirulence protein AvrXa7-#38 [*Xanthomonas oryzae* pv. *oryzae*]<br>HAWRNALTGAPLNLTPDQVVAIASNIGGKQALETVQRLLPVLCQDHGLTPDQVVAIASHGGGKQALETVQ RLLPVLCQDHGLTPDQVVAIASNIGGKQALETVQRLLPVLCQAHGLTPDQVVAIASNIGGKQALETVQRL LPVLCQDHGLTPAQVVAIASNSGGKQALETVQRLLPVLCQDHGLTPDQVVAIASHDGGKQALETVQRLLP VLCQDHGLTPDQVVAIANNNGGKQALETLQRLLPVLCQDHGLTPDQVVAIASHDGGKQALETVQRLLPVL |

TABLE 1-continued

Endogenous TALE Polypeptide Sequences

CQDHGLTPDQVVAIASHDGGKQALETVQRLLPVLCQDHGLTPAQVVAIASHDGGKQALETVQRLLPVLCQ
DHGLTPDQVVAIASNSGGKQALETVQRLLPVLCQDHGLTPDQVVAIASNGGKQALETVQRLLPVLCQDHG
LTPDQVVAIASNGGKQALETVQRLLPVQRLLPVLCQDHGLTQDQVVAIASHDGGKQALETVQRLLPVLCQ
DHGLTPDQVVAIASHDGGKQALETVQRLLPVLCQDHGLTPDQVVAIASNGGKQALETVQRLLPVLCQDHG
LTPNQVVAIASNSGGKQALETVQRLLPVLCQDHGLTPNQVVAIASNGGKQALESIVAQLSRPDPALAALT
NDHLVALACLGGSPALDAVKKGLPHAPELIRRINRRIPERTSHRVPDLAHVVRVLGFFQSHSHPAQAFDD
AMKQFEMSRHGLVQLFRRVGVTEFEARYGTLPPASQRWDRILQASGMKRAKPSPTSAQTPDQASLHA

SEQ ID NO: 34
>gi|50312766|gb|AAS58129.3|avirulence protein PthXo5 [*Xanthomo-
nas oryzae* pv.
*oryzae*]
HAWRNALTGAPLNLTPDQVVAIASNIGGKQALETVQRLLPVLCQDHGLTPDQVVAIASHGGGKQALETVQ
RLLPVLCQDHGLTPDQVVAIASNIGGKQALETVQRLLPVLCQAHGLTPDQVVAIASNIGGKQALETVQRL
LPVLCQDHGLTPAQVVAIASNSGGKQALETVQRLLPVLCQDHGLTPDQVVAIASHDGGKQALETVQRLLP
VLCQDHGLTPDQVVAIASNIGGKQALETVQRLLPVLCQDHGLTPDQVVAIASHDGGKQALETVQRLLPVL
CQDHGLTPAQVVAIASHGGGKQALETVQRLLPVLCQAHGLTPDQVVAIASHDGGKQALETVQRLLPVLCQ
AHGLTPNQVVAIASNIGGKQALETVQRLLPVLCQDHGLTPDQVVAIASNGGKQALETVQRLLPVLCQAHG
LTPDQVVAIASNSGGKQALETVQRLLPVLCQDHGLTPNQVVAIASNIGGKQALETVQRLLPVLCQDHGLT
PDQVVAIASNIGGKQALETVQRLLPVLCQDHGLTLDQVVAIASHGGGKQALETVQRLLPVLCQDHGLTLD
QVVAIASNGGKQALETVQRLLPVLCQDHGLTPNQVVAIASNSGGKQALETVQRLLPVLCQDHGLTPNQVV
AIASNGGKQALESIVAQLSRPDPALAALTNDHLVALACLGGRPALDAVKKGLPHAPELIRRINRRIPERT
SHRVPDLAHVVRVLGFFQSHSHPAQAFDDAMTQFEMSRHGLVQLFRRVGVTEFEARYGTLPPASQRWDRI
LQASGMKRAKPSPTSAQTPDQASLHA SEQ ID NO: 35
>gi|50312768|gb|AAS58130.3|avirulence protein AvrXa7-sacB50 [*Xanthomonas
oryzae* pv. *oryzae*]
HAWRNALTGAPLNLTPNQVVAIASNIGGKQALETVQRLLPVLCQDHGLTPDQVVAIASHGGGKQALETVQ
RLLPVLCQDHGLTPDQVVAIASNIGGKQALETVQRLLPVLCQAHGLTPDQVVAIASNIGGKQALETVQRL
LPVLCQDHGLTPAQVVAIASNSGGKQALETVQRLLPVLCQDHGLTPDQVVAIASHDGGKQALETVQRLLP
VLCQDHGLTPDQVVAIASNIGGKQALETVQRLLPVLCQDHGLTLDQVVAIASNGGKQALETVQRLLPVLC
QDHGLTPNQVVAIASNSGGKQALETVQRLLPVLCQDHGLTPNQVVAIASNGGKQALESIVAQLSRPDPAL
AALTNDHLVALACLGGRPALDAVKKGLPHAPELIRRINRRIPERTSHRVPDLAHVVRVLGFFQSHSHPAQ
AFDDAMTQFEMSRHGLVQLFRRVGVTEFEARYGTLPPASQRWDRILQASGMKRAKPSPTSAQTPDQASLH
A SEQ ID NO: 36
>gi|51850109|dbj|BAD42396.1|AvrBs3 family protein [*Ralstonia solan-
acearum*]
MRIGKSSGWLNESVSLEYEHVSPPTRPRDTRRRPRAASDGGLAHLHRRLAVGYAEDTPRTGARSPAPRRP
LPVAPASAPPAPSLVPEPPMPVSLPVVSSPRFSAGSSAAITDPFSSLPPTPVLYAMARELKALSDATWQP
AVPLPAEPPTDARRGNTVFDEASASSPVIASACPQAFASPPRAPRSARARRARTGGDAWPAPTFLSRPSS
SRIGRDVFGKLVALGYSREQIRKLKQESLSEIAKYHTTLTGQGFTHADICRISRRRQSLRVVARNYPELA
AALPELTRAHIVDIARQRSGDLALQALLPVATALTAAPLRLSASQIATVAQYGERPAIQALYRLRRKLTR
APLHLTPQQVVAIASHDGGKPALEAVWAKLPVLRGVPYALSTAQVVAIACISGQQALEATEAHMPTLRQA
PHSLSPERVAAIACIGGRSAVEAVRQGLPVKAIRRIRREKAPVAGPPPASLGPTPQELVAVLHFFRAHQQ
PRQAFVDALAAFQTTRPALLRLLSSVGVTEIEALGGTIPDATERWQRLLGRLGFRPATGAAAPSPDSLQG
FAQSLERTLGSPGMAGQSACSPHRKRPAETAIAPRSIRRRPNNAGQPSEPWPDQLAWLQRRKRTARSHIR
ADSAASVPANLHLGTRAQFTPDRLRAEPGPIMQAHTSPASVSFGSHVAFEPGLPDPGTPTSADLASFEAE
PFGVGPLDFHLDWLLQILEA SEQ ID NO: 37
>gi|57919063|gb|AAW59491.1|Avr/Pth13 [*Xanthomonas oryzae* pv. *oryzicola*]
MDPIRPRRPSPARELLPGPQPDRVQPTADRGGAPPAGGPLDGLPARRTVSRTRLPSPPAPSPAFSAGSFS
DLLRPFDPSLPDTSLFDSMPAVGTPHTAAAPAEWDEMQSALRAADDPSPTVRVAVTAARQPRAKPAPRRR
AAQPSDASPAAQVDLRTLGYSQQQQEKIKPNVRSTVAQHHEALVGHGFTHAHIVALSQHPAALGTVAVTY
QHIITALPEATHEDIVGVGKQWSGARALEALLTKAGELRGPPLQLDTGQLLKIAKRGGVTAVEAVHASRN
ALTGAPLNLTPAQVVAIASNGGKQALETVQRLLPVLCQAHGLTLDQVVAIASNNGGKQALETVQRLLPVL
CQARGLTPDQVVAIASHDGGKQALETVQRLLPVLCQDHGLIPAQVVAIASHDGGKQALETVQRLLPVLCQ
DHGLTPDQVVAIASHDGGKQALETVQRLLPVLCQDHGLTPDQVVAIASNGGGKQALESIVAQLSRPDPAL
AALTNDHLVALACLGGRPALDAVKKGLPHAPELIRRVNSRIGERTSHRVADYAQVVRVLEFFQSHSQPAQ
AFDDAMTQFGMSRHGLVQLFRRVGVTELEASGGTLPPASQRWHRILQASGMKRAKPSPTSAQTPDQASLH
AFADSLERDPDAPSPMHEGDQTRASSRKRSRSDRAVTGPSAQQSFEVRVPEQRDALHLPLSWSVKRPRTR
IGGGLPDPGTPMAADLAASSTVMWEQDADPFAGAADDFPAFNEEELAWLMELLPQ SEQ ID NO: 38
>gi|57919108|gb|AAW59492.1|Avr/Pth3 [*Xanthomonas oryzae* pv. *oryzicola*]
MDPIRPRRPSPARELLPGPQPDRIQPTADRGGAPPAGGPLDGLPARRTMSRTRLPSPPAPSPAFSAGSFS
DLLRPFDPSLLDTSLLDSMPAVGTPHTAAAPAEWDEMQSALRAADDPPPTVCVAVTAARPPRAKPAPRRR
AAQPSDASPAAQVDLRTLGYSQQQQEKIKPNVRSTVAQHHEALVGHGFTHAHIVALSQHPAALGTVAVKY
QHIITALPEATHEDIVGVGKQWSGARALEALLTDAGELRGPPLQLDTGQLLKIAKRGGVTAVEAVHASRN
ALTGAPLNLTPDQVVAIASNSGGKQALEMVQRLLPVLCQAHGLTPAQVVAIASHDGGKQALETVQRLLPV
LCQAHGLTPDQVVAIASNIGGKQALETVQRLLPVLCQAHGLTPDQVVAIASNGGKQALETVQRLLPVLCQ
AHGLTPDQVVAIASNIGGKQALETVQRLLPVLCQDHGLTPDQVVAIASHGGGKQALETVQRLLPVLCQDH
GLTPDQVVAIASNGGGKQALETVQRLLPVLCQDHGLTPDQVVAIASHDGGKQALETVQRLLPVLCQDHGL
TPDQVVAIANNNGGKQALETLQRLLPVLCQAHGLTPAQVVAIASNIGGKQALETVQRLLPVLCQAHGLTP
DQVVAIASNGGSKQALETVQRLLPVLCQDHGLTPDQVVAIASHDGGKQALETVQRLLPVLCQDHGLTPAQ TABLE 1-continued Endogenous TALE Polypeptide Sequences VVAIANNNGGKQALETVQRLLPVLCQDHGLSPAQVVAIASNSGGKQALETVQRLLPVLCHDHGLTPAQVV
AIANNNGGKQALETVQRLLPVLCQDHGLTPAQVVAIASNGGGKQALETVQRLLPVLCQDHGLTPDQVVAI
ASNNGGKQALESIVAHLSRPDPALAALTNDHLVALACLGGRPALDAVKKGLPHAPELIRRVNSRIGERTS
HRVADYAQVVRVLEFFQCHSHPAHAFDEAMTQFGMSRNGLLQLFRRVGVTELEARGGTLPPASQRWHRIL
QASGMKRAEPSPTSAQTPDQASLHAFADSLERDLDAPSPMHEGDQTRASSRKRSRSDRAVTGPSAQQAVE
VRVPEQRDALHLPLSWRVKRPRTRIGGGLPDPGTPMAADLAASSTVXWEQDAAPFAGAADDFPAFNEEEL
AWLRELLPQ SEQ ID NO: 39
>gi|57919146|gb|AAW59493.1|Avr/Pth14 [*Xanthomonas oryzae* pv. *oryzicola*]
MDPIRPRRPSPARELLPGPQPDRIQPTADRGGAPPAGGPLDGLPARRTMSRTRLPSPPAPSPAFSAGSFS
DLLRPFDPSLLDTSLLDSMPAVGTPHTAAAPAEWDEMQSALRAADDPPPTVCVAVTAARPPRAKPAPRRR
AAQPSDASPAAQVDLRTLGYSQQQQEKIKPNVRSTVAQHHEALVGHGFTHAHIVALSQHPAALGTVAVKY
QHIITALPEATHEDIVGVGKQWSGARALEALLTDAGELRGPPLQLDTGQLLKIAKRGGVTAVEAVHASRN
ALTGAPLNLTPDQVVAIASNSGGKQALEMVQRLLPVLCQAHGLTPAQVVAIASHDGGKQALETVQRLLPV
LCQAHGLTPDQVVAIASNIGGKQALETVQRLLPVLCQAHGLTPDQVVAIASNGGKQALETVQRLLPVLCQ
AHGLTPDQVVAIASNIGGKQALETVQRLLPVLCQDHGLTPDQVVAIASHGGGKQALETVQRLLPVLCQDH
GLTPDQVVAIASNIGGKQALETVQRLLPVLCQDHGLTLEQVVAIASNIGGKQALETVQRLLLVLCQAHGL
TPDQVVAIASNGGKQALETVQRLLPVLCQAHGLTPDQVVAIASNGGGKQALETVQRLLPVLCQDHGLTPD
QVVAIASHDGGKQALETVQRLLPVLCQDHGLTPDQVVAIANNNGGKQALETLQRLLPVLCQAHGLTPAQV
VAIASNIGGKQALETVQRLLPVLCQAHGLTPDQVVAIASNGGSKQALETVQRLLPVLCQDHGLTPDQVVA
IASHDGGKQALETVQRLLPVLCQDHGLTPAQVVAIANNNGGKQALETVQRLLPVLCQDHGLSPAQVVAIA
SNSGGKQALETVQRLLPVLCHDHGLTPAQVVAIANNNGGKQALETVQRLLPVLCQDHGLTPAQVVAIASN
GGGKQALETVQRLLPVLCQDHGLTPDQVVAIASNNGGKQALESIVAHLSRPDPALAALTNDHLVALACLG
GRPALDAVKKGLPHAPELIRRVNSRIGERTSHRVADYAQVVRVLEFFQCHSHPAHAFDEAMTQFGMSRNG
LLQLFRRVGVTELEARGGTLPPASQRWHRILQASGMKRAEPSPTSAQTPDQASLHAFADSLERDLDAPSP
MHEGDQTRASSRKRSRSDRAVTGPSAQQAVEVRVPEQRDALHLPLSWRVKRPRTRIGGGLPDPGTPMAAD
LAASSTVMWEQDAAPFAGAADDFPAFNEEELAWLRELLPQ SEQ ID NO: 40
>gi|58428473|gb|AAW77510.1|avirulence protein [*Xanthomo-
nas oryzae* pv. *oryzae*
KACC10331]
MAASRRWRRCSGCCRCCARTMALTPDQVVAIASNGGGKQALETVQRLLPVLCQDHGLTPDQVVAIASHDG
GKQALETVQRLLPVLCQDHGLTPAQVVAIASHDGGKQALETVQRLLPVLCQDHGLTPDQVVAIASHDGGK
QALETVQRLLPVLCQDHGLTPDQVVAIASNGGGKQALKTVQRLLPVLCQDHGLTPDQVVAIASNGGGKQA
LESIVAQLSCPDPALAALTNDHLVALACLGGRPALDAVKKGLPHAPELIRRINRRIPERTSHRVADLAHV
VRVLGFFQSHSHPAQAFDDAMTQFGMSRHGLVQLFRRVGVTEFEARYGTLPPASQRWDRILQASGMKRAK
PSPTSAQTPDQASLHAFADSLERDLDAPSPMHEGDQTRASSRKRSRSDRAVTDPSAQQSFEVRVPEQHDT
LHLPLSWRVKRPRTRIGGGLPDPGTPIAADLAASSTVMWEQDAAPFAGAADDFPAFNEEELAWLMELLPQ
SGSVGGTI SEQ ID NO: 41
>gi|58580860|ref|YP_199876.1|avirulence protein [*Xanthomonas oryzae* pv.
*oryzae* KACC10331]
MGSLAVSTEISHNPLPILHAGPGSPSCLRLTLVVEGCQDHPKLCTAMRPGKLCRDHRPLVWRRPCKEVCL
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEAQSGLRAADDPPPTVPVAVTAARPPRAKPAPRRR
AAQPSDASPAAQVDLRTLGYSQQQQEKIKPKVRSTVAQHHEALVGHGFTHAHIVALSQHPAALGTVAVTY
QDIIRALPEATHEDIVGVGKQWSGARALEALLTKAGELRGPPLQLDTGQLVKIAKRGGVTAVEAVHASRN
ALTGAPLNLTPDQVVAIASNIGGKQALETVQRLLPVLCQDHGLTPDQVVAIANNNGGKQALETVQRLLPV
LCQDHGLTPDQVVAIASNIGGKQALETVQRLLPVLCQDHGLTPDQVVAIASHGGGKQALETVQRLLPVLC
QDHGLTPDQVVAIASHGGGKQALETLQRLLPVLCQDHGLTPDQVVAIASHDGGKQALETVQRLLPVLCQD
HGLTPDQVVAIASNGGGKQALETLQRLLPVLCQDHGLTPDQVVAIASHDGGKQALETVQRLLPMLCQDHG
LTPDQVVAIASHGGGKQALETVQRLLPVLCQDHGLTPDQVVAIASHDGGKQALETVQRLLPVLCQDHGLT
LDQVVAIASHDGGKKALETVQRLLPVLCQDHGLTPDQVVAIASHDGGKQALETVQRLLPVLCQDHGLTPD
QVVAIASNGGGKQALESIVAQLSRPDPALAALTNDHLVALACLGGRPALDAVKKGLPHAPELIRRVNRRI
GERTSHRVADYAQVVRVLEFFQCHSHPAQAFDDAMTQFGMSRHGLVQLFRRVGVTEFEARCGTLPPASQR
WDRILQASGMKRAKPSPTSAQTPDQASLHAFADSLERDLDAPSPMHEGDQTRASSRKRSRSDRAVTGPST
QQSFEVRVPEQRDALHLPLSWRVKRPRTRIGGGLPDPGTPIAADLAASSTVMWEQDAAPFAGAADDFPAF
NEEELAWLMELLPQSGSVGGTI SEQ ID NO: 42
>gi|58580861|ref|YP_199877.1|avirulence protein [*Xanthomonas oryzae* pv.
*oryzae* KACC10331]
MQRLLPVLCQDHGLTPDQVVAIASHDGGKQALETVQRLLPVLCQDHGLTPAQAVAIASNGGGKQALETVQ
RLLPVLCQDHGLTPDQVVAIASNGGKQALETVQRLLPVLCQDHGLTPDQVVAIASNGGKQALETVQRLLP
VLCQDHGLTLAQVVAIASNIGGKQALETVQRLLPVLCQDHGLTPDQVVAIASNIGGKQALETVQRLLPVL
CQDHGLTPDQVVAIASNNGGKQALETVQRLLPVLCQDHGLTPDQVVAIASHDGGKQALETVQRLLPVLCQ
DHGLTPAQVVAIASHIGGKQALETVQRLLPVLCQDHGLTLDQVVAIASNDGSKQALETVQRLLPVLCQDH
GLTPDQVVAIASHDGGKQALETVQRLLPVLCQDHGLTPNQVVAIASNIGGKQALETVQRLLPVLCQAHGL
TPDQVVAIASHDGGKQALETVQRLLPVLCQNHGLTPDQVVAIASNGGGKQALETVQRLLPVLCQDHGLTP
DQVVAIASNGGGKQALESIVAQLSRPDPALAALTNDHLVALACLGGRPALDAVKKGLPHAPELIRRINRR
IPERTSHRVADYAQVVRVLEFFQCHSHPAYAFDEAMTQFGMSRNGLVQLFRRVGVTELEARCGTLPPASQ
RWDRILQASGMKRAKPSPTSAQTPDQASLHAFADSLERDLDAPSPMHEGDQTRASSRKRSRSDRAVTGPS
AQQSFEVRVPEQRDALHLPLSWRVKRPRTRIGGGLPDPGTPIAADLAASSTVMWEQDAAPFAGAADDFPA
FNEEELAWLMELLPQSGSVGGTI TABLE 1-continued Endogenous TALE Polypeptide Sequences SEQ ID NO: 43
>gi|58580862|ref|YP_199878.1|avirulence protein [*Xanthomonas oryzae* pv. *oryzae* KACC10331]
MCTAMRPGKLCRDHRPLVWRRPCKEVCLMDPIRSRTPSPARELLPGPQPDRVQPTADRGGAPPAGGPLDG
LPARRTMSRTRLPSPPAPSPAFSAGSFSDLLRQFDPSLLDTSLLDSMPAVGTPHTAAAPAEWDEAQSGLR
AADDPPPTVRVAVTAARPPRAKPAPRRRAAQPSDASPAAQVDLRTLGYSQQQQEKIKPKVRSTVARHHEA
LVGHGFTHAHIVALSQHPAALGTVAVTYQDIIRALPEATHEDIVGVGKQWSGARALEALLTEAGELRGPP
LQLDTGQLLKIAKRGGVTAVEAVHAWRNALTGAPLNLTPAQVVAIASHDGGNQALETVQRLLPVLCQDHG
P SEQ ID NO: 44
>gi|58581750|ref|YP_200766.1|hypothetical protein XOO2127 [*Xanthomonas oryzae* pv. *oryzae* KACC10331]
MCTAMRPRKLCRDHRPLVWRRPCKEVCLMDPIRSRTPSPARELLPGPQPDRVQPTADRGGAPPAGGPLDG
LPARRTMSRTRLPSPPAPSPAFSAGSFSDLLRQFDPSLLDTSLLDSMPAVGTPHTAAAPAECDEVQSGLR
AADDPPPTVRVAVTAARPPRAKPAPRRRAAQPSDASPAAQVDLRTLGYSQQQQEKIKPKVRSTVAQHHEA
LVGHGFTHAHIVALSQHPAALGTVAVTYQDIIRALPEATHEDIVGVGKQWSGARALEALLTEAGELRGPP
LQLDTGQLLKIAKRGGVTAVQAVHAWRNALTGAPLNLTPDQVVAIASNIGGKQALETVQRLLPVLCQAHG
LNPDQVVAIASNSGGKQALETVQRLLPVLCQDHGLTLDQVVAIASHDGGKQALETVQRLLPVLCQDHGLT
PDQVVAIASNGGGKQALETVQRLLPVLCQDHGLTPDQVVAIASNSGGKQALETVQRLLPVLCQDHGLSPD
QVVAIANNNGGKQALETVQRLLPVLCQDHGLSPDQVVAIASHDGGKQALETVQRLLPVLCQDHGLTPDQV
VAIASNGGKQALETVQRLLPVLCQDHGLTPDQVVAIANNNGGKQALETVQRLLPVLCQDHGLTPDQVVAI
ANNNGGKQALETVQRLLPVLCQAHGLPPDQVVAIASNIGGKQALETVQRLLPVLCQDHGLTPDQVVAIAN
NNGGKQALETVQRLLPVLCQDHGLTPDQVVAIASHDGGKQALETVQRLLPVLCQDHGLTPDQVVAIASNG
GGKQALETVQRLLPVLCQDHGLSPDQVVAIASHDGGKQALETVQRLLPVLCQDHGLTLDQVVAIASHDGG
KQALETVQRLLPVLCQAHGLTPDQVVAIASHDGGKQALETVQRLLPVLCQDHGLTPDQVVAIASNGGGKQ
ALESIVAQLYRPDPALAALTNDHLVALACLGGRPALDAVKKGLPHAPELIRRINRRIPERTSHRVADLAH
VVRVLGFFQSHSHPAQAFDDAMTQFGMSRHGLVQLFRRVGVTEFEARYGTLPPASQRWDRILQASGMKRA
KPSPTSAQTPDQASLHAFADSLERDLDAPSPMHEGDQTRASSRKRSRSDRAVTGPSTQQSFEVRVPEQRD
ALHLPLSWRVKRPRTRIGGGLPDPGTPIAADLAASSTVMWEQDADPFAGAADDFPAFNEEELAWLMELLP
QSGSVGGTI SEQ ID NO: 45
>gi|58581751|ref|YP_200767.1|hypothetical protein XOO2128 [*Xanthomonas oryzae* pv. *oryzae* KACC10331]
MCTAMRPRKLRRDHRPLVWRRPCKEVCLMDPIRSRTPSPARELLPGPQPDRVQPTADRGGAPPAGGPLDG
LPARRTMSRTRLPSPPAPSPAFSAGSFSDLLRQFDPSLLDTSLLDSMPAVGTPHTAAAPAECDEVQSGLR
AADDPPPTVRVAVTAARPPRAKPAPRRRAAQPSDASPAAQVDLRTLGYSQQQQEKIKPKVRSTVAQHHEA
LVGHGFTHAHIVALSQHPAALGTVAVTYQDIIRALPEATHEDIVGVGKQWSGARALEALLTEAGELRGPP
LQLDTGQLLKIAKRGGVTAVEAVHAWRNALTGAPLNLTPDQVVAIASNIGGNQALETVQRLLPVLCQAHG
LTPDQVVAIASHGGGKQALETVQRLLPVLCQDHGLTPDQVVAIASNIGGKQALETVQRLLPVLCQDHGLT
PDQVVAIASNIGGKQALETVQRLLPVLCQDHGLTPDQVVAIASNIGGKQALETVQRLLPVLCQDHGLTPD
QVVAIANNNGGKQALETVQRLLPVLCQDHGLTPDQVVAIASHDGGKQALETVQRLLPVLCQGHGLTPDKV
VAIASNSGGKQALETVQRLLPVLCQAHGLTPDKVVAIANNNGGKQALETVQRLLPVLCQDHGLTPDQVVA
IASNSGGKQALETVQRLLPVLCQDHGLTPAQVVAIANNNGGKQALETVRRLLPVLCQDHGLTPDQVVAIA
SHDGGKQALETVQRLLPVLCQDHGLTPDQVVAIANNNGGKQALETVQRLLPVLCQDHGLTQDQVVAIASN
IGGKQALETVQRLLPVLCQDHGLTPDQVVAIASHDGGKQALETVQRLLPVLCQDHGLTPAQVVAIANNNG
GKQALETVQRLLPVLCQDHGLSPDQVVAIASNIGGKQALETVQRLLPVLCQDHGLTPDQVVAIASNGGGK
QALETVQRLLPVLCQDHGLSPDQVVAIASHDGGKQALETVQRLLPVLCQDHGLTPDQVVAIASNGGGKQA
LESIVAQLSRPDPALAALTNDHLVALACLGGRPAMDAVKKGLPHAPELIRRVNSRIGERTSHRVADYAQV
VRVLEFFQCHSHPAYAFDEAMTQFGMSRNGLLQLFRRVGVTELEARGGTLPPASQRWDRILQASGMKRAK
PSPTSAQTPDQASLHAFADSLERDLDAPSPMHEGDQTGASSRKRSRSDRAVTGPSAQQSFEVRVPEQHDA
LHLPLSWRVKRPRTRIGGGLPDPGTPIAADLAASSTVLWEQDAAPFAGAADDFPAFNEEELAWLMELLPQ
SGSVGGTI SEQ ID NO: 46
>gi|58581754|ref|YP_200770.1|avirulence protein [*Xanthomonas oryzae* pv. *oryzae* KACC10331]
MCTAMRPGKLCRDHRPLVWRRPCKEVCLMDPIRSRTPSPARELLPGPQPDRVQPTADRGGAPPAGGPLDG
LPARRTMSRTRLPSPPAPSPAFSAGSFSDPLRQFDPSLLDTSLFDSMPAVGTPHTAAAPAEWDEAQSALR
AADDPPPTVRVAVTAARPPRAKPAPRRRAAQPSDASPAAQVDLRTLGYSQQQQEKIKPKVRSTVAQHHEA
LVGHGFTHAHIVALSKHPAALGTVAVTYQHIITALPEATHEDIVGVGKQWSGARALEALLTDAGELRGPP
LQLDTGQLLKIAKRGGVTAVEAVHASRNALTGAPLNLTPAQVVAIASNNGGKQALETVQRLLPVLCQAHG
LTPAQVVAIASHDGGKQALETVQRLLPVLCQDHGLTPDQVVAIASNSGGKQALETVQRLLPVLCQDHGLT
PDQVVAIASNGGGKQALETVQRLLPVLCQDHGLTPDQVVAIASHDGGKQALETVQRLLPVLCQDHGLTPD
QLVAIANNNGGKQALETVQRLLPVLCQDHGLTPDQVVAIASNGGKQALETVQRLLPVLCQDHGLTPDQVV
AIASNIGGKQALETVQRLLPVLCQAHGLTPAQVVAIASHDGGKQALETMQRLLPVLCQAHGLTPAQVVAI
ASNSGGKQALETVQRLLPVLCQDHGLTPAQVVAIVSHDGGKQALETVQRLLPVLCQAHGLTPDQVVAIAS
NNGGKQALETVQRLLPVLCQDHGLTPDQVVAIASHDGGKQALGTVQRLLPVLCQDHGLTPDQVVAIASNN
GGKQALETVQRLLPVLCQDHGLTPDQVVAIASHDGGKQALETVQRLLPVLCQAHGLTPAQVVAIASNNGG
KQALETVQRLLPVLCQDHGLTPDQVVAIANNNGGKQALETVQRLLPVLCQAHGLTPAQVVAIASNNGSKQ
ALETVQRLLPVLCQAHGLTPAQVVAIASNNGGKQALETVQRLLPVLCQAHGLTPDQVVAIASNNGGKQAL
ETVQRLLPVLCQAHGLTPDQVVAIASNNGGKQALETVQRLLPVLCQAHGLTPDQVVAIASNNGGKQALET
VQRLLPVLCQDHGLTPAQVVAIASHDGGKQALETVQRLLPVLCQDHGLTPAQVVAIASNGGGKQALESIV
AQLSRPDPALAALTNDHLVALACLGGRPALDAVKKGLPHAPELIRRVNSRIGERTSHRVADYAQVVRVLE TABLE 1-continued

| Endogenous TALE Polypeptide Sequences |
|---|
| FFQCHSHPAYAFDEAMTQFGMSRNGLLQLFRRVGVTELEARGGTLPPASQRWDRILQASGMKRAKPSPTS AQTPDQASLHAFADSLERDLDAPSPMHEGDQTRASSRKRSRSDRAVTGPSAQQSFEVRVPEQRDALHLPL SWRVKRPRTRIGGGLPDPGTPMAADLAASSTVMWEQDAAPFAGAADDFPAFNEEELAWLMELLPQSGSVG GTI |
| SEQ ID NO: 47 |
| >gi\|58581887\|ref\|YP_200903.1\|hypothetical protein XOO2264 [*Xanthomonas oryzae* pv. *oryzae* KACC10331] |
| MCTAMRPGKLCRDHRPLVWRRPCKEVCLMDPIRSRTPSPARELLPGPQPDRVQPTADRGGAPPAGGPLDG LPARRTMSRTRLPSPPAPSPAFPAGSFSDLLRQVDTSLLDSMPAVGTPHTAAAPAEWDEMQSGLRAADDP PPTVRVAVTAARPPRAKPAPRRRAAQPSDASPAAQVDLRTLGYSQQQQEKIKPKVRSTVAQHHEALVGHG FTHAHIVALSQHPAALGTVAVKYQHIITALPEATHEDIVGVGKQWSGARALEALLTKAGELRGPPLQLDT GQLLKIAKRGGVTAVEAVHAWRNALTGAPLNLTPDQVVAIASNIGGKQALETVQRLLPVLCQAHGLTPDQ VVAIANNNGGKQALETVQRLLPVLCQDHGLTPAQVVAIASNNGGKQALETVQRLLPVLCQDHGLTPDQVV AIASNIGGKQALETVQRLLPVLCQDHGLTPDQVVAIASNIGGKQALETVQRLLPVLCQDHGLTPDQVVAI ASNIGGKQALETVQRLLPVLCQDHGLTPDQVVAIASNSGGKQALETVQRLLPVLCQDHGLTPAQVVAIAS HGGGKQALETVQRLLPVLCQAHGLTPDQVVAIASHDGGKQALETVQRLLPVLCQAHGLTPNQVVAIASNI GGKQALETVQRLLPVLCQDHGLTPAQVVAIASNGGKQALETVQRLLPVLCQAHGLTPDQVVAIASNSGGK QALETVQRLLPVLCQDHGLTPNQVVAIASNIGGKQALETVQRLLPVLCQDHGLTPDQVVAIASNIGGKQA LETVQRLLPVLCQDHGLTPAQVVAIANNNGGKQALETVQRLLPVLCQDHGLTPDQVVAIASNIGGKQALE TVQRLLPVLCQDHGLTPDQVVAIASNGGKQALESIVAQLSRPDPALAALTNDHLVALACLGGRPALDAV KKGLPHAPELIKRINRRIPERTSHRVADLPERTSHRVADLAHVVRVLGFFQSHSHPAQAFDDAMTQFGMS RHGLVQLFRRVGVTEFEARCGTLPPASQRWDRILQASGMKRAKPSPTSAQTPDQASLHAFADSLERDLDA PSPMHEGDQTRASSRKRSRSDRAVTGPSTQQSFEVRVPEQHDALHLPLSWRVKRPRTRIGGGLPDPGTPI AADLAASSTVMWEQDAAPFAGAADDFPAFNEEELAWLMELLPQSGSVGGTI |
| SEQ ID NO: 48 |
| >gi\|58581898\|ref\|YP_200914.1\|avirulence protein [*Xanthomonas oryzae* pv. *oryzae* KACC10331] |
| MCTAMRPRKLCRDHRPLVWRQPCKEVCLMDPIRSRTPSPARELLPGPQPDRVQPTADRGGTPPAGGPLDG LPVRRTMSRTRLPSPPAPSPAFSAGSFSDLLRQFDPSLLDTSLLDSMPAVGTPHTAAAPAEWDEVQSGLR AADDPPPTVRVAVTAARPPRAKPAPRRRAAQPSDASPAAQVDLRTLGYSQQQQEKIKPKVRSTVAQHHEA LVGHGFTHAHIVALSQHPAALGTVAVTYQDIIRALPEATHEDIVGVGKQWSGARALEALLTEARELRGPP LQLDTGQLLKIAKRGGVTAVEAVHAWRNALTGAPLNLTPDQVVAIASNIGGNQALETVQRLLPVLCQAHG LTPDQVVAIASNGGKQALETVQRLLPVLCQDHSLTPDQVVAIASNIGGKQALETVQRLLPVLCQDHGLTP DQVVAIASNSGGKQALETVQRLLPVLCQDHGLTPDQVMTIASNNGGKQALETVQRLLPVLCQDHGLTPDQ VVTIASNGGGKQALETVQRLLPVLCQAHGLTPDQVVAIANNNGGKQALETVQRLLPVLCQAHGLTPAQVV AIASNSGGKQALETVQRLLPVLCQAHGLTPDQVVAIASNGGKQALETVQRLLPVLCQAHGLTPDQVVAIA SNSGGKQALETVQRLLPVLCQAHGLTPDQVVAIANNNGGKQALETVQRLLPVLCQAHGLTPDQVVAIASN SGGKQALETVQRLLPVLCQDHGLTPDQVVAIASNGGKQALETVQRLLPVLCQDHGLTPDQVVAIASHDGG KQALETVQRLLPVLCQDHGLTLDQVVAIASHGGGKQALETVQRLLPVLCQDHGLTSDQVVAIASHDGGKQ ALETVQRLLPVLCQDHGLTPDQVVAIASHDGGKQALETVQRLLPVLCQDHGLTLDQVVAIASHDGGKQAL ETVQRLLPVLCQAHGLTPDQVVAIASNSGGKQALETVQRLLPVLCQDHGLTPDQVVAIASNGGKQALETV QRLLPVLCQDHGLTPDQVVAIASHDGGKQALETVQRLLPVLCQDHGLTLDQVVAIASHGGGKQALETVQR LLPVLCQDHGLTSDQVVAIASHDGGKQALETVQRLLPVLCQDHGLTPDQVVAIASHDGGKQALETVQRLL PVLCQDHGLTLDQVVAIASHDGGKQALETVQRLLPVLCQDHGLTPDQVVAIASHDGGKQALETVQRLLPV LCQDHGLTPAQVVAIASNGGGKQALESIVAQLSRPDPALAALTNDHLVALACLGGRPALDAVKKGLPHAP ELIRRINRRIPERTSHRVADYAQVVRVLEFFQCHSHPAYAFDEAMTQFGMSRHGLVQLFRRVGVTEFEAR CGTLPPASQRWDRILQASGMKRAKPSPTSAQTPDQASLHAFADSLERDLDAPSPMHEGDQTRASSRKRSR SDRAVTGPSTQQSFEVRVPEQRDALHLPLSWRVKRPRTRIGGGLPDPGTPIAADLAASSTVMWEQDAAPF AGAADDFPAFNEEELAWLMELLPQSGSVGGTI |
| SEQ ID NO: 49 |
| >gi\|58581899\|ref\|YP_200915.1\|hypothetical protein XOO2276 [*Xanthomonas oryzae* pv. *oryzae* KACC10331] |
| MGSLAVSTEISHNPLPILHAGPGSPSCLRLTLVVEGCQDHPKLCTAMRPGKLCRDHRPLVWRRPCKEVCL MDPIRSRTPSPARELLPGPQPDRVQPTADRGGAPPAGGPLDGLPARRTMSRTRLPSPPAPSPAFSAGSFS DLLRQFDPSLLDTSLLDSIPAVGTPHTAAAPAEWDEVQSGLRAADDPPPTVRVAVTAARPPRAKPAPRRR AAQPSDASPAAQVDLRTLGYSQQQQEKIKPKVRSTVAQHHEALVGHGFTHAHIVALSQHPAALGTVAVTY QDIIRALPEATHEDIVGVGKQWSGARALEALLTKAGELRGPPLQLDTGQLLKIAKRGGVTAVEAVHAWRN ALTGAPLNLTPDQVVAIASNIGGNQALETVQRLLPVLCQAHGLTPDQVVAIASHGGGKQALETVQRLLPV LCQDHGLTPDQVVAIASNIGGKQALETVQRLLPVLCQDHGLTPDQVVAIASNGGGKQALETLQRLLPVLC QAHGLTPDQVLAIASHGGGKQALETLQRLLPVLCQDHGLTPAQVVALASHDGGKQALETVQRLLPVLCQD HGLTPAQVVAIASNSGGKQALETVQRLLPVLCQDHGLTPDQVVAIASNGGGKQALETVQRLLPVLCQDHG LTPDQVVAIASHDGGKQALETVQRLLPVLCQDHGLTPDQVVAIANNNGGKQALETVQRLLLVLCQAHGLT PDQVVAIASNGGGKQALETVQRLLPVLCQDHGLTPDQVVAIASHGGGKQALETVQRLLPVLCQDHGLTPD QVVAIASNGGGKQALETVQRLLPVLCQDHGLTPDQVVAIASHDGGKQALETVQRLLPVLCQDHGLTPDQV VAIASHGGGKQALETVQRLLPVLCQDHGLTPDQVVAIASHDGGKQALETVQRLLPVLCQDHGLTPDQVVA IASHDGGKQALETVQRLLPVLCQDHGLTLDQVVAIASNIGGKQALETVQRLLPVLCQDHGLTPDQVVAIA NNNGGKQALETVQRLLPVLCQDHGLTPDQVVAIASNGGGKQALESIVAQLSCPDPALAALTNDHLVALAC LGGRPALDAVKKGLPHAPELIRRINRRIPERTSHRVADLPERTSNRVADLAHVVRVLGFFQSHSHPAQAF DDAMTQFGMSRHGLVQLFRRVGVTELEARCGTLPPASQRWDRILQASGMKRAKPSPTSAQTPDQASLHAF ADSLERDLDAPSPMHEGDQTRASSRKRSRSDRAVTGPSAQQSFEVRVPEQRDALHLPLSWRVKRPRTRIG GGLPDPGTPIAADLAASSTVLWEQDAAPFAGAADDFPAFNEEELAWLMELLPQSGSVGGTI |

TABLE 1-continued

| Endogenous TALE Polypeptide Sequences |
|---|

SEQ ID NO: 50
>gi|58581902|ref|YP_200918.1|avirulence protein [*Xanthomonas oryzae* pv. *oryzae* KACC10331]
MGRFWFSGTSILHTRKLRHRALRHAVLGADLRHRTGVVADDVRRTQYALGDPANAYCHQVSGGAFVSRRR
NDLPAGRTRGLAGIRIKKQPKVGSLAVSTEIFHNLLPILHAGPGSPSCLRLTLVVEGCQDHPKLCTAMRP
RKLCRDHRPLVWRQPCKEVCLMDPIRSRTPSPARELLPGPQPDRVQPTADRGGAPPAGGPLDGLPARRTM
SRTRLPSPPAPSPAFSAGSFSDLLRQFDPSLLDTSLLDSMPAVGTPHTAAAPAECDEVQSGLRAADDPPP
TVRVAVTAARPPRAKPAPRRRAAQPSDASPAAQVDLRTLGYSQQQQEKIKPKVRSTVAQHHEALVGHGFT
HAHIVALSQHPAALGTVAVTYQDIIRALPEATHEDIVGVGKQWSGARALEALLTEARELRGPPLQLDTGQ
LLKIAKRGGVTAVEAVHAWRNALTGAPLNLTPDQVVAIASNIGGNQALETVQRLLPVLCQDHGLTPDQVV
AIASHGGKQALETVQRLLPVLCQDHGLTPDQVVAIASNIGGKQALETVQRLLPVLCQAHGLTPAQVVAIA
SNNGGKQALETVQRLLPVLCQAHGLTPAQVVAIASNNGGKQALETVQRLLPVLCQAHGLTPDQVVAIANN
NGGKQALETVQRLLPVLCQDHGLSPDQVVAIANNNGGKQALETLQRLLPVLCQTHALTPDQVVAIANNNG
GKQALETVQRLLPVLCQDHGLTPDQVVAIASHDGGKQALETVQRLLPVLCQDHGLTPDQVVAIASNIGGK
QALETVQRLLPVLCQDHGLTPDQVVAIASNSGGKQALETVQRLLPVLCQDHGLTPAQVVAIASHGGGKQA
LETVQRLLPVLCQAHGLTPDQVVAIASHDGGKQALETVQRLLPVLCQAHGLTPNQVVAIASNIGGKQALE
TVQRLLPVLCQDHGLTPAQVVAIASNGGKQALETVQRLLPVLCQAHGLTPDQVVAIASNSGGKQALETVQ
RLLPVLCQDHGLTPNQVVAIASNIGGKQALETVQRLLPVLCQDHGLTPDQVVAIASNIGGKQALETVQRL
LPVLCQDHGLTLDQVVAIASHDGGKQALETVQRLLPVLCQAHGLTPYQVVAIASNGGKQALETVQRLLPV
LCQAHGLTPNQVVAIASNSGGKQALETVQRLLPVLCQDHGLTPNQVVAIASNIGGKQALETVQRLLPVLC
QDHGLTPNQVVAIASNGGKQALESIVAQLSRPDPALAALTNDHLVALACLGGRPALDAVKKGLPHAPELI
RRINRRIPERTSHRVPDLAHVVRVLGFFQSHSHPAQAFDDAMTQFGMSRHGLVQLFRRVGVTEFEARYGT
LPPASQRWDRILQASGMKRAKPSPTSAQTPDQASLHAFADSLERDLDALSPMHEGDQTRASSRKRSRSDR
AVTGPSAQQSFEVRVPEQRDALHLPLSWRVKRPRTRIGGGLPDPGTPIAADLAASSTVMWEQDAAPFAGA
ADDFPAFNEEELAWLMELLPQSGSVGGTI SEQ ID NO: 51
>gi|58582636|ref|YP_201652.1|avirulence protein [*Xanthomonas oryzae* pv. *oryzae* KACC10331]
MCTAMRPRKLCRDHRPLVWRRPCKEVCLMDPIRSRTPSPARELLPGPQPDRVQPTADRGGAPPAGGPLDG
LPARRTMSRTRLPSPPAPSPAFSAGSFSDLLRQFDPSLLDTSLLDSMPAVGTPHTAAAPAECDEVQSGLR
AADDPPPTVRVAVTAARPPRAKPAPRRRAAQPSDASPAAQVDLRTLGYSQQQQEKIKPKVRSTVAQHHEA
LVGHGFTHAHIVALSQHPAALGTVAVTYQDIITALPEATHEDIVGVGKQWSGARALEALLTEARELRGPP
LQLDTGQLLKIAKRGGVTAVEAVHAWRNALTGAPLNLTPDQVVAIASNIGGKQALETVQRLLPVLCQDHG
LTPDQVVAIASNGGGKQALETVQRLLPVLCQDHGLTPDQVVAIASNNGGKQALETVQRLLPVLCQDHGLT
PDQVVAIASNGGGKQALETVQRLLPVLCQDHGLTPDQVVAIANNKGGKQALETLQRLLPVLCQAHGLTPD
QVVAIASNGGGKQALETVQRLLPVLCQDHGLTPAQVVAIASNIGGKQALETVQRLLPVLCQDHGLTPDQV
VAIANNNGGKQALETVQRLLPVLCQDHGLTPDQVVTIASNIGGKQALEMVQRLLPVLCQDHGLTPDQVVA
IANNNGGKQALETVQRLLPVLCQAHGLTPDQVVAIASNIGGKQTLETVQRLLPVLCQDHGLTPDQVVAIA
NNNGGKQALETVQRLLPVLCQDHGLTPDQVVAIASNSGGKQALETVQRLLPVLCQDHGLTPNQVVAIASN
GGGKQALETVQRLLPVLCQDHGLTPDQVVGIASNSGGKQALETVQRLLPVLCQDHGLTPDQVVAIANNNG
GKQALETVQRLLPVLCQDHGLTPDQVVAIASNIGGKQALETVQRLLPVLCQDHGLTLDKVVAIASNGGKQ
ALETVQRLLPVLCQDHGLTPDQVVAIASNSGGKQALETVQRLLPVLCQDHGLTPDQVVAIASNGGGKQAL
ESIVAQLSRPDPALAALTNDHLVALACLGGRPAMDAVKKGLPHAPELIRRVNRRIGERTSHRVADYAQVV
RVLEFFQCHSHPAYAFDEAMTQFGMSRNGLVQLFRRVGVTELEARGGTLPPASQRWDRILQASGMKRAKP
SPTSAQTPDQASLHAFADSLERDLDAPSPMHEGDQTGASSRKRSRSDRAVTGPSAQQSFEVRVPEQHDAL
HLPLSWRVKRPRTRIGGGLPDPGTPIAADLAASSTVLWEQDAAPFAGAADDFPAFNEEELAWLMELLPQS
GSVGGTI SEQ ID NO: 52
>gi|58582637|ref|YP_201653.1|avirulence protein [*Xanthomonas oryzae* pv. *oryzae* KACC10331]
MGSLAVSTEISHNPLPILHAGPGSPSCLRLTLVVEGCQDHPKLCTAMRPGKLCRDHRPLVWRRPCKEVCL
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVKY
QHIITALPEATHEDIVGVGKQWSGARALEALLTKAGELRGPPLQLDTGQLLKIAKRGGVTAVEAVHAWRN
ALTGAPLNLTPDQVVAIASNIGGKQALETVQRLLPVLCQDHGLTPDQVVAIASHGGGKQALETVQRLLPV
LCQDHGLTPDQVVAIASNIGGKQALETVQRLLPVLCQAHGLTPDQVVAIASNIGGKQALETVQRLLPVLC
QDHGLTPAQVVAIASNSGGKQALETVQRLLPVLCQDHGLTPDQVVAIASHDGGKQALETLQRLLPVLCQD
HGLTPDQVVAIANNNGGKQALETLQRLLPVLCQDHGLTPDQVVAIASHDGGKQALETVQRLLPVLCQDHG
LTPDQVVAIASHGGGKQALETVQRLLPVLCQDHGLTPDQVVAIASNIGGKQALETVQRLLPVLCQDHGLT
PDQVVAIASNIGGKQALETVQRLLPVLCQDHGLTPDQVVAIASHGGGKQALETVQRLLPVLCQAHGLTPD
QVVAIARHDGGKQALETVQRLLPVLCQAHGLTPDQVVAIANNNGGKQALETVQRLLPVLCQAHGLTPDQV
VAIASHDGGKQALETVQRLLPVLCQAHGLTPDQVVAIASHDGGKQALETVQRLLPVLCQDHGLTPDQVVA
IASHDGGKQALETVQRLLPVLCQDHGLTPDQVVAIASNIGGKQALETVQRLLPVLCQDHGLTPDQVVAIA
SNIGGKQALETVQRLLPVLCQDHGLTPDQVVAIANNNGGKQALETVQRLLPVQRLVPVLCQDHGLTQDQV
VAIASNIGGKQALETVQRLLPVLYQDHGLTQDQVVAIASHDGGKQALETVQRLLPVLCQDHGLTPDQVVA
IASHDGGKQALETVQRLLPVLCQEHGLTPDQVVAIASHDGGKQALETVQRLLPVLCQDHGLTPDQVVAIA
SHGGGKQALGTVQRLLPVLCQDHGLTPDQVVAIANNNGGKQALETVQRLLPVLCQDHGLTPDQVVAIANN
NGGKQALETVQRLLPVLCQAHGLTPDQVVAIASHDGGKQALETVQRLLPVLCQDHGLTPAQVVAIASNSG
GKQALETVQRLLPVLCQDHGLTPAQVVAIANNNGGKQALETVQRLLPVLCQDHGLTPDQVVAIASHDGGK
QALETVQRLLPVLCQDHGLTLDQVVAIASNGGKQALETVQRLLPVLCQDHGLTPNQVVAIASNSGGKQAL
ETVQRLLPVLCQDHGLTPNQVVAIASNGGKQALESIVAQLSRPDPALAALTNDHLVALACLGGRPALDAV
KKGLPHAPELIRRINRRIPERTSHRVPDLAHVVRVLGFFQSHSHPAQAFDDAMTQFGMSRHGLVQLFRRV TABLE 1-continued

| Endogenous TALE Polypeptide Sequences |
|---|

GVTEFEARYGTLPPASQRWDRILQASGMKRAKPSPTSAQTPDQASLHAFADSLERDLDAPSPMHEGDQTR
ASSRKRSRSDRAVTDPSTQQSFEVRVPEQRDALHLPLSWRVKRPRTRIGGGLPDPGTPIAADLAASSTVM
WEQDAAPFAGAADDFPAFNEEELAWLMELLPQSGSVGGTI

SEQ ID NO: 53
>gi|58582638|ref|YP_201654.1|avirulence protein [*Xanthomonas oryzae* pv. *oryzae* KACC10331]
MGSLAVSTEIFHNLLPILHAGPGSPSCLRLTLVVEGCQDHPKLCTAMRPRKLCRDHRPLVWRQPCKEVCL
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVKY
QHIITALPEATHEDIVGVGKQWSGARALEALLTKAGELRGPPLQLDTGQLLKIAKRGGVTAVEAVHAWRN
ALTGAPLNLTPDQVVAIASNIGGKQALETVQRLLPVLCQDHGLTPDQVVAIASHGGGKQALETVQRLLPV
LCQDHGLTPDQVVAIASNIGGKQALETVQRLLPVLCQAHGLTPDQVVAIASNIGGKQALETVQRLLPVLC
QDHGLTPAQVVAIASNSGGKQALETVQRLLPVLCQDHGLTPDQVVAIASHDGGKQALETLQRLLPVLCQD
HGLTPDQVVAIANNNGGKQALETLQRLLPVLCQDHGLTPDQVVAIASHDGGKQALETVQRLLPVLCQDHG
LTPDQVVAIASHDGGKQALETVQRLLPVLCQDHGLTPAQVVAIASHDGGKQALETVQRLLPVLCQDHGLT
PDQVVAIASNSGGKQALETVQRLLPVLCQDHGLTPDQVVAIASNGGKQALETVQRLLPVLCQDHGLTPDH
VVAIASNGGKQALETVQRLLPVQRLLPVLCQDHGLTQDQVVAIASHDGGKQALETVQRLLPVLCQDHGLT
PDQVVAIASHDGGKQALETVQRLLPVLCQDHGLTPDQVVAIASNSGGKQALETVQRLLPVLCQDHGLTPD
QVVAIASNSGGKQALETVQRLLPVLCQDHGLTPDQVVAIASNNGGKQALETVQRLLPVLCQDHGLTPNQV
VAIASNGGKQALESIVAQLSRPDPALAALTNDHLVALACLGGRPALDAVKKGLPHAPELIRRINRRIPER
TSHRVPDLAHVVRVLGFFQSHSHPAQAFDDAMTQFEMSRHGLVQLFRRVGVTEFEARYGTLPPASQRWDR
ILQASGMKRAKPSPTSAQTPDQASLHAFADSLERDLDAPSPMHEGDQTGASSRKRSRSDRAVTGPSAQQS
FEVRVPEQRDALHLPLSWRVKRPRTRIGGGLPDPGTPIAADLAASSTVMWEQDAAPFAGAADDFPAFNEE
ELAWLMELLPQSGSVGGTI SEQ ID NO: 54
>gi|58583878|ref|YP_202894.1|avirulence/virulence protein [*Xanthomonas oryzae* pv. *oryzae* KACC10331]
MGDVAGGVEGCQDPPKLCTAMRPRKLCRDHRPLVWRRTCKEVCLMDPIRSRTPSPARELLPGPQPDRVQP
TADRGGGAPPAGGPLDGLPARRTMSRTRLPSPPAPSPAFSAGSFSDLLRQFDPSLLDTSLLDSMPAVGTP
HTAAAPAECDEVQSGLRAADDPPPTVRVAVTAARPPRAKPAPRRRAAQPSDASPAAQVDLRTLGYSQQQQ
EKIKPKVRSTVAQHHEALVGHGFTHAHIVALSQHPAALGTVAVTYQDIIRALPEATHEDIVGVGKQWSGA
RALEALLTKAGELRGPPLQLDTGQLLKIAKRGGVTAVEAVHAWRNALTGAPLNLTPDQVVAIASNIGGKQ
ALETVQRLLPVLCQAHGLTPDQVVAIASHGGGKQALETVQRLLPVLCQDHGLTPAQVVAIASNIGGKQAL
ETVQRLLPVLCQDHGLTPAQVMAIANNNGGKQALETVQRLLPVLCQDHGLTPAQVVAIASNIGGKQALET
VQRLLPVLCQDHGLTPTQVMAIANNNGGKQALETVQRLLPVLCQAHGLTPDQVVAIASHDGGKQALETVQ
RLLPVLCQAHGLTPDQVVAIASHDGGKQALETVQRLLPVLCQDHGLTPAQVVAIASHDGGKQALETVQRL
LPVPVLCQAHGLTPDQVVAIASHDGGKQALETVQRLLPVLCQDHGLTPDQVVAIASNSGGKQALETVQRL
LPVLCQDHGLTPDQVVAIASNSGGKQALETVQRLLPVPVLCQAHGLTPDQVVAIASHDGGKQALETVQRL
LPVLCQDHGLTPDQVVAIASNIGGKQALETVQRLLPVLCQDHGLTPDQVVAIASNIGGKQALETVQRLLP
VLCQDHGLTPDQVVAIASHDGGKQALETVQRLLPVLCQDHGPDPGPGRGHRQQWRRQAGAGDGATAVAGA
VPGPWPDPGPGRGHRQPRWRQAGAGDGAAAVAGAVPGPWPDPGPSGGHRQPRWRQAGAGDGAAAVAGVVP
GPWPDPGPGGGHRQPRWRQAGAGDGAAAVAGAVPGPWPDPGPGGGHRQQWRRQAGAEDGAAAVAGAVPGP
WPDPGPGGGHRQQWRRQAGAGEHCCPVILP SEQ ID NO: 55
>gi|66270057|gb|AAY43358.1|Hax2 [*Xanthomonas campestris* pv. *armoraciae*]
MDPIRSRTPSPARELLSGPQPDGVQPTADRGVSPPAGGPLDGLPARRTMSRTRLPSPPAPSPAFSADSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNNGGKQALETVQRLLPVLCQAPHDLTPEQVVAIASIGGGKQALETVQRLLP
VLCQAPHDLTPEQVVAIASNGGGKQALETVQRLLPVLCQAPHCLTPEQVVAIASNIGGKQALETVQALLP
VLCQAPHCLTPEQVVAIASNGGGKQALETVQRLLPVLCQAPHDLTPEQVVAIASNGGGKQALETVQRLLP
VLCQAPHDLTPEQVVAIASHDGGKQALETVQRLLPVLCQAPHDLTPQQVVAIASNGGGKQALETVQRLLP
VLCQAPHDLTPEQVVAIASHDGGKQALETVQRLLPVLCQAPHDLTPEQVVAIASNIGGKQALETVQALLP
VLCQAPHCLTPEQVVAIASHDGGKQALETVQALLPVLCQAPHDLTPEQVVAIASNIGGKQALETVQRLLP
VLCQAPHDLTREQVVAIASHDGGKQALETVQRLLPVLCQAPHDLTPEQVVAIASNGGGKQALETVQRLLP
VLCQAPHDLTPEQVVAIASHDGGKQALETVQRLLPVLCQAPHDLTPEQVVAIASNGGGKQALETVQRLLP
VLCQAPHDLTPEQVVAIASHDGGKQALETVQRLLPVLCQAPHDLTPEQVVAIASHDGGKQALETVQRLLP
VLCQAPHDLTPEQVVAIASNGGGKQALETVQRLLPVLCQAPHDLTPEQVVAIASNGGGKQALETVQALLP
VLCQAPHDLTPEQVVAIASNIGGKQALETVQRLLPVLCQAPHDLTPEQVVAIASNGGGKQALESIFAQLS
RPDPALAALTNDRLVALACIGGRSALNAVKKDGLPNALTLIRRANSRIPERTSHLVADHTQVVRVLGFFQC
HSHPAQAFDEAMTQFGMSRHGLLQLFRRVGVTELEARSGTLPPASQRWDRILQASGMKRAKPSPTSTQTP
DQASLHAFADSLERDLDAPSPMHEGDQTRASSRKRSRSDRAVTGPSAQQSFEVRVPEQRDALHLPLLSWG
VKRPRTRIGGLLDPGTPMDADLVASSTVVWEQDADPFAGTADDFPAFNEEELAWLMELLPH SEQ ID NO: 56
>gi|66270059|gb|AAY43359.1|Hax3 [*Xanthomonas campestris* pv. *armoraciae*]
MDPIRSRTPSPARELLSGPQPDGVQPTADRGVSPPAGGPLDGLPARRTMSRTRLPSPPAPSPAFSADSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQRLLPVLCQAHGLTPQQVVAIASHDGGKQALETVQRLLPV
LCQAHGLTPEQVVAIASNIGGKQALETVQALLPVLCQAHGLTPEQVVAIASHDGGKQALETVQRLLPVLC
QAHGLTPQQVVAIASHDGGKQALETVQRLLPVLCQAHGLTPQQVVAIASHDGGKQALETVQRLLPVLCQA TABLE 1-continued Endogenous TALE Polypeptide Sequences HGLTPQQVVAIASNSGGKQALETVQRLLPVLCQAHGLTPQQVVAIASNSGGKQALETVQRLLPVLCQAHG
LTPQQVVAIASNSGGKQALETVQRLLPVLCQAHGLTPEQVVAIASHDGGKQALETVQRLLPVLCQAHGLT
PEQVVAIASNIGGKQALETVQRLLPVLCQAHGLTPQQVVAIASNGGGRPALESIVAQLSRPDPALAALTN
DHLVALACLGGRPALDAVKKGLPHAPALIKRTNRRIPERTSHRVADHAQVVRVLGFFQCHSHPAQAFDDA
MTQFGMSRHGLLQLFRRVGVTELEARSGTLPPASQRWDRILQASGMKRAKPSPTSTQTPDQASLHAFADS
LERDLDAPSPMHEGDQTRASSRKRSRSDRAVTGPSAQQSFEVRVPEQRDALHLPLLSWGVKRPRTRIGGL
LDPGTPMDADLVASSTVVWEQDADPFAGTADDFPAFNEEELAWLMELLPQ SEQ ID NO: 57
>gi|66270061|gb|AAY43360.1|Hax4 [*Xanthomonas campestris* pv. *armoraciae*]
MDPIRSRTPSPARELLSGPQPDGVQPTADRGVSPPAGGPLDGLPARRTMSRTRLPSPPAPSPAFSADSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQALLPVLCQAHGLTPQQVVAIASHDGGKQALETVQRLLPV
LCQAHGLTPEQVVAIASHDGGKQALETVQRLLPVLCQAHGLTPQQVVAIASNGGGKQALETVQRLLPVLC
QAHGLTPEQVVAIASNSGGKQALETVQALLPVLCQAHGLTPQQVVAIASNSGGKQALETVQALLPVLCQA
HGLTPEQVVAIASNIGGKQALETVQRLLPVLCQAHGLTPQQVVAIASHDGGKQALETVQRLLPVLCQAHG
LTPQQVVAIASNGGGKQALETVQRLLPVLCQAHGLTPEQVVAIASNIGGKQALETVQALLPVLCQAHGLT
PQQVVAIASNSGGKQALETVQALLPVLCQAHGLTPEQVVAIASNIGGKQALETVQRLLPVLCQAHGLTPE
QVVAIASNGGGKQALETVQRLLPVLCQAHGLTPEQVVAIASNIGGKQALETVQALLPVLCQAHGLTPEQV
VAIASNGGGRPALESIVAQLSRPDPALAALTNDHLVALACLGGRPALDAVKKGLPHAPALIKRTNRRIPE
RTSHRVADHAQVVRVLGFFQCHSHPAQAFDDAMTQFGMSRHGLLQLFRRVGVTELEARSGTLPPASQRWD
RILQASGMKRAKPSPTSTQTPDQASLHAFADSLERDLDAPSPMHEGDQTRASSRKRSRSDRAVTGPSAQQ
SFEVRVPEQRDALHLPLSWRVKRPRTSIGGGLPDPGTPTAADLAASSTVMREQDEDPFAGAADDFPAFNE
EELAWLMELLPQ SEQ ID NO: 58
>gi|66735948|gb|AAY54166.1|R19.5 [*Xanthomonas oryzae* pv. *oryzae*]
DLRTLGYSQQQQEKIKPKVRSTVAQHHEALVGHGFTHAHIVALSQHPAALGTVAVTYQDIIRALPEATHE
DIVGVGKQWSGARALEALLTEAGELRGPPLQLDTGQLLKIAKRGGVTAVKAVHAWRNALTGAPLNLTPAQ
VVAIASHDGGNQALETVQRLLPVLCQDHGLTPAQVVAIASHDGGKQALETVQRLLPVLCQDHGLTPDQVV
AIASHDGGKQALETVQRLLPVLCQDHGLTPAQAVAIASNGGGKQALETVQRLLPVLCQDHGLTPDQVVAI
ASNGGKQALETVQRLLPVLCQDHGLTPDQVVAIASNNGGKQALETVQRLLPVLCQDHGLTPDQVVAIASH
DGGKQALETVQRLLPVLCQDHGLTPDQVVAIASHDGGKQALETVQRLLPVLCQDHGLTPDQVVAIASNGG
KQALETVQRLLPVLCQDHGLTLAQVVAIASNIGGKQALETVQRLLPVLCQDHGLTPDQVVAIASNIGGKQ
ALETVQRLLPVLCQDHGLTPDQVVAIASNNGGKQALETVQRLLPVLCQDHGLTPDQVVAIASHDGGKQAL
ETVQRLLPVLCQDHGLTPAQVVAIASHIGGKQALETVQRLLPVLCQDHGLTLDQVVAIASNDGSKQALET
VQRLLPVLCQDHGLTPDQVVAIASHDGGKQALETVQRLLPVLCQDHGLTPNQVVAIASNIGGKQALETVQ
RLLPVLCQAHGLTPDQVVAIASHDGGKQALETVQRLLPVLCQNHGLTPDQVVAIASNGGGKQALETVQRL
LPVLCQDHGLTPDQVVAIASNGGGKQALESIVAQLSRPDPALAALTNDHLVALACLGGRPALDAVKKGLP
HAPELIRRINRRIPERTSHRVADLAHVVRVLGFFQSHSHPAQAFDDAMTQFGMSRHGLVQLFRRVGVTEL
EARCGTLPPASQRWDRILQASGMKRAKPSPTSAQTPDQASLHAFADSLERDLDAPSPMHEGDQTRASNRK
RSRSDRAVTGPSTQQSFEVRVPEQRDALHLPLSWRVKRPRTRIGGGLPDPGTPIAADLAASSTVMWEQDA
APFAGAADDFPAFNEEELAWLMELLPQSGSVGGTI SEQ ID NO: 59
>gi|66735950|gb|AAY54168.1|AvrXa27 [*Xanthomonas oryzae* pv. *oryzae*]
MDPIRSRTPSPARELLPGPQPDRVQPTADRGGAPPAGGPLDGLPARRTMSRTRLPSPPAPSPAFSAGSFN
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKSKVRSTVAQHHEALVGHGFTHAHIVALSQHPAALGTVAVKY
QHIITALPEATHEDIVGVGKQWSGARALEALLTKAGELRGPPLQLDTGQLLKIAKRGGVTAVEAVHASRN
ALTGAPLNLTPDQVVAIASNIGGNQALETVQRLLPVLCQDHGLTPDQVVAIANNNGGKQALETVQRLLPV
LCQAHGLTPDQVVAIASNGGKQALETVQRLLPVLCQAHGLTPNQVVAIASNGGGKQALETVQRLLPVLCQ
AHGLTQDQVVAIASNSGGKQALETVQRLLPVLCQAHGLTPAQVVAIASNNGGKQALETVQRLFPVLCQDH
GLTPDQVVTIANNNGGKQALETVQRLLPVLCQAHGLIPDQVVAIANNNGGKQALETVQRLLPVLCQAHGL
TPAQVVAIASNIGGKQALETVQRLLPVLCRAHGLTPAQVVAIANNNGGKQALETVQRLLPVLCQAHGLTP
DQVVAIASNIGGKQALETVQRLLPVLCQDHGLTPDQVVAIASNGGKQALETVQRLLPVLCQDHGLTPAQV
VAIASHDGGKQALETVQRLLPVLCQDHGLTLDQVVAIASHDGGKQALETVQRLLPVLCQDHGLTLDQVVA
IASNIGGKQALETVQRLLPVLCQDHGLTPDQVVAIASNGGGKQALETVQRLLPVLCQDHGLTPDQVVAIA
SNGGGKQALESIVAQLSRPDPALAALTNDHLVALACLGGRPALDAVKKGLPHAPELIRRINRRIPERTSH
RVADLAHVVRVLGFFQSHSHPAQAFDDAMTQFGMSRHGLVQLFRRVGVTEFEARCGTLPPASQRWDRILQ
ASGMKRAKPSPTSAQTPDQASLHAFADSLERDLDAPSPMHEGDQTRASSRKRSRSDRAVTGPSTQQSFEV
RVPEQRDALHLPLSWRVKRPRTRIGGGLPDPGTPIAADLAASSTVMWEQDAAPFAGAADDFPAFNEEELA
WLMELLPQSGSVGGTI SEQ ID NO: 60
>gi|66735951|gb|AAY54169.1|R13.5 [*Xanthomonas oryzae* pv. *oryzae*]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAECDEVQSGLRAADDPPPTVRVAVTAARPPRAKPAPRRR
AAQPSDASPAAQVDLRTLGYSQQQQEKMKPKVRSTVAQHHEALVGHGFTHAHIVALSQHPAALGTVAVTY
QDIIRALPEATHEDIVGVGKQWSGARTLEALLTEAGELRGPPLQLDTGQLLKIAKRGGVTAVEAVHAWRN
ALTGAPLNLTPDQVVAIASNIGGKQALETVQRLLPVLCQDHGLTPDQVVAIASNNGGKQALETVQRLLPV
LCQAHGLTPDQVVAIASNIGGKQALETVQRLLPVLCQDHGLTPDQVVAIASHGGGKQALETVQRLLPVLC
QDHGLTPDQVVAIASHGGGKQALETVQRLLPVLCQDHGLTPDQVVAIANNVGGKQALATVQRLLPVLCQD
HGLTPDQVVAIASHGGGKQALETVQRLLPVLCQDHGLTPDQVVAIASHDGGKQALETVQRLLPVLCQDHG
LTPDQVVAIASHGGGKQALETVQRLLPVLCQDHGLTPDQVVAIASHDGGKQALETVQRLLPVLCQDHGLT
LDQVVAIASHDGGKKALETVQRLLPVLCQDHGLTPDQVVAIASHDGGKQALETVQRLLPVLCQDHGLTPD TABLE 1-continued

| Endogenous TALE Polypeptide Sequences |
|---|
| QVVAIASNGGGKQALESIVAQLSRPDPALAALTNDHLVALACLGGRPALDAVKKGLPHAPELIRRVNSRI<br>GERTSHRVADYAQVVRVLEFFQCHSHPAYAFDEAMTQFGMSRHGLVQLFRRVGVTEFEARCGTLPPASQR<br>WDRILQASGMKRAKPSPTSAQTPDQASLHAFADSLERDLDAPSPMHEGDQTRASSRKRSRSDRAVTGPSA<br>QQSFEVRVPEQRDALHLPLSWRVKRPRTRIGGGLPDPGTPIAADLAASSTVMWEQDAAPFAGAADDFPAF<br>NEEELAWLMELLPQSGSVGGTI |
| SEQ ID NO: 61<br>>gi\|66735952\|gb\|AAY54170.1\|R23.5 [*Xanthomonas oryzae* pv. *oryzae*]<br>MDPIRSRTPSPARELLPGPQPDRVQPTADRGGAPPAGGPLDGLPARRTMSRTRLPSPPAPSPAFSAGSFS<br>DPLRQFDPSLLDTSLFDSMPAVGTPHTAAAPAEWDEAQSALRAADDPPPTVRVAVTAARPPRAKPAPRRR<br>AAQPSDASPAAQVDLRTLGYSQQQQEKIKPKVRSTVAQHHEALVGHGFTHAHIVALSQHPAALGTVAVTY<br>QHIITALPEATHEDIVGVGKQWSGARALEALLTDAGELRGPPLQLDTGQLLKIAKRGGVTAVEAVHASRN<br>ALTGAPLNLTPAQVVAIASNNGGKQALETVQRLLPVLCQAHGLTPAQVVAIASHDGGKQALETVQRLLPV<br>LCQDHGLTPDQVVAIASNSGGKQALETVQRLLPVLCQDHGLTPDQVVAIASNGGGKQALETVQRLLPVLC<br>QDHGLTPDQVVAIASHDGGKQALETVQRLLPVLCQDHGLTPDQLVAIANNNGGKQALETVQRLLPVLCQD<br>HGLTPDQVVAIASNGGKQALETVQRLLPVLCQDHGLTPDQVVAIASNIGGKQALETVQRLLPVLCQAHGL<br>TPAQVVAIASHDGGKQALETMQRLLPVLCRAHGLTPAQVVAIASNSGGKQALETVQRLLPVLCQAHGLTP<br>AQVVAIVSHDGGKQALETVQRLLPVLCQAHGLTPDQVVAIASNNGGKQALETVQRLLPVLCQDHGLTPDQ<br>VVAIASHDGGKQALGTVQRLLPVLCQDHGLTPDQVVAIASNNGGKQALETVQRLLPVLCQDHGLTPDQVV<br>AIASHDGGKQALETVQRLLPVLCQAHGLTPAQVVAIASNNGGKQALETVQRLLPVLCQDHGLTPDQVVAI<br>ANNNGGKQALETVQRLLPVLCQAHGLTPAQVVAIASNNGSKQALETVQRLLPVLCQAHGLTPAQVVAIAS<br>NNGGKQALETVQRLLPVLCQAHGLTPDQVVAIASNNGGKQALETVQRLLPVLCQAHGLTPDQVVAIASNN<br>GGKQALETVQRLLPVLCQAHGLTPDQVVAIASNNGGKQALETVQRLLPVLCQDHGLTPAQVVAIASHDGG<br>KQALETVQRLLPVLCQDHGLTPAQVVAIASNGGGKQALESIVAQLSRPDPALAALTNDHLVALACLGGRP<br>ALDAVKKGLPHAPELIRRVNSRIGERTSHRVADYAQVVRVLEFFQCHSHPAYAFDEAMTQFGMSRNGLLQ<br>LFRRVGVTELEARGGTLPPASQRWDRILQASGMKRAKPSCASAQTPDQASLHAFADSLERDLDAPSPMHE<br>GDQTRASSRKRSRSDRAVTGPSAQQSFEVRVPEQRDALHLPLSWRVKRPRTRIGGGLPDPGTPMAADLAA<br>SSTVMWEQDAAPFAGAADDFPAFNEEELAWLMELLPQSGSVGGTI |
| SEQ ID NO: 62<br>>gi\|81295674\|gb\|ABB70129.1\|PthXo7 [*Xanthomonas oryzae* pv. *oryzae*]<br>MDPIRSRTPSPARELLPGPQPDRIQPTADRGGAPPAGGPLDGLPARRTMSRTRLPSPPAPSPAFSAGSFS<br>DLLRQFDPSLLDTSLLDSMPAVGTPHTAAAPAECDEVQSGLRAADDPPPTVRVAVTAARPPRAKPAPRRR<br>AAQPSDASPAAQVDLRTLGYSQQQQEKIKPKVRSTVAQHHEALVGHGFTHAHIVALSQHPAALGTVAVTY<br>QDIIRALPEATHEDIVGVGKQWSGARALEALLTEARELRGPPLQLDTGQLLKIAKRGGVTAVEAVHAWRN<br>ALTGAPLNLTPDQVVAIASNIGGKQALETVQRLLPVLCQDHGLTPDQVVAIARNGGGKQALETVQRLLPV<br>LCQDHGLTPDQVVAIASNIGGKQALETVQRLLPVLCQDHGLTPDQVVAIASNIGGKQALATVQRLLPVLC<br>QAHGLTPDQVVAIASNGGKQALETVQRLLPVLCQDHGLTPDQVVAIASNNGGKQALETVQRLLPVLCQDH<br>GLTPDQVVAIASHDGGKQALETVQRLLPVLCQDHGLTPDQVVAIASHDGGKQALETVQRLLPVLCQDHGL<br>TPDQVVAIASNGGKQALETVQRLLPVLCQDHGLTLAQVVAIASNIGGKQALETVQRLLPVLCQDHGLTPD<br>QVVAIASNIGGKQALETVQRLLPVLCQDHGLTPDQVVAIASNIGGKQALETVQRLLPVLCQAHGLTPDQV<br>VAIASNGGGKQALETVQRLLPVLCQDHGLTPDQVVAIASHDGGKQALETVQRLLPVLCQDHGLTPDQVVA<br>IASHGGGKQALETVQRLLPVLCQDHGLTPDQVVAIANNNGGKQALETVQRLLPVLCQDHGLTPAQVVAIA<br>SNSGGKQALETVQRLLPVLCQDHGLTPDQVVAIANNNGGKQALEMVQRLLPVLCQDHGLTPDQVVAIASH<br>DGGKQALETVQRLLPVLCQDHGLTLDQVVAIASHDGGKQALETVQRLLPVLCQDHGLTPDQVVAIASNGG<br>GKQALETVQRLLPVLCQDHGLTPAQVVAIASNGGKQALESIVAQLSRPDPALAALTNDHLVALACLGGRP<br>ALDAVKKGLPHAPELIRRINRRIPERTSHRVPDLAHVVRVLGFFQSHSHPAQAFDDAMTQFEMSRHGLVQ<br>LFRRVGVTEFEARYGTLPPASQRWDRILQASGMKRAKPSPTSAQTPDQASLHAFADSLERDLDAPSPMHE<br>GDQTGASSRKRSRSDRAVTGPSAQQSFEVRVPEQRDALHLPLSWRVKRPRTRIGGGLPDP |
| SEQ ID NO: 63<br>>gi\|81295792\|gb\|ABB70183.1\|PthXo6 [*Xanthomonas oryzae* pv. *oryzae*]<br>MDPIRSRTPSPARELLPGPQPDRVQPTADRGGAPPAGGPLDGLPARRTMSRTRLPSPPAPSPAFSAGSFS<br>DLLRQFDPSLLDISLLDSMPAVGTPHTAAAPAEWDEVQSGLRAADDPPPTVRVAVTAARPPRAKPAPRRR<br>AAQPSDASPAAQVDLRTLGYSQQQQEKIKPKVRSTVAQHHEALVGHGFTHAHIVALSQHPAALGTVAVTY<br>QDIIRALPEATHEDIVGVGKQWSGARALEALLTEARELRGPPLQLDTGQLLKIAKRGGVTAVEAVHAWRN<br>ALTGAPLNLTPDQVVAIASNIGGNQALETVQRLLPVLCQDHGLTPDQVVAIASHGGKQALETVQRLLPVL<br>CQDHGLTPDQVVAIASNIGGKQALETVQRLLPVLCQDHGLTPAQVVAIASNNGGKQALETVQRLLPVLCQ<br>AHGLTPDQVVAIASNNGGKQALETVQRLLPVLCQAHGLTPDQVVAIANNNGGKQALETVQRLLPVLCQDH<br>GLSPDQVVAIANNNGGKQALETLQRLLPVLCQTHALTPDQVVAIANNNGGKQALETVQRLLPVLCQDHGL<br>TPDQVVAIASHDGGKQALETVQRLLPVLCQDHGLTPDQVVAIASNIGGKQALETVQRLLPVLCQDHGLTP<br>DQVVAIASHDGGKQALETVQRLLPVLCQDHGLTPAQVVAIASHGGGKQALETVQRLLPVLCQAHGLTPDQ<br>VVAIASHDGGKQALETVQRLLPVLCQAHGLTPNQVVAIASNIGGKQALETVQRLLPVLCQDHGLTPDQVV<br>AIASNGGKQALETVQRLLPVLCQAHGLTPDQVVAIASNSGGKQALETVQRLLPVLCQDHGLTPNQVVAIA<br>SNIGGKQALETVQRLLPVLCQDHGLTPDQVVAIASNIGGKQALETVQRLLPVLCQDHGLTLDQVVAIASH<br>GGGKQALETVQRLLPVLCQDHGLTSDQVVAIASHDGGKQALETVQRLLPVLCQDHGLTPDQVVAIASNSG<br>GKQALETVQRLLPVLCQDHGLTPAQVVAIASNSGGKQALETVQRLLPVLCQAHGLTPNQVVAIASNGGGK<br>QALESIVAQLSRPDPALAALTNDHLVALACLGGRPALDAVKKGLPHAPNLIRRVNSRIGERTSHRVADLA<br>QVVRVLEFFQCHSHPAHAFDEAMTQFGMSRNGLLQLFRRVGVTELEARGGTLPPASQRWDRILQASGMKR<br>AKPSPTSAQTPDQASLHAFADSLERDLDALSPMHEGDQTRASSRKRSRSDRAVTGPSAQQSFEVRVPEQH<br>DALHLPLSWRVKRPRTRIGGGLPDP |
| SEQ ID NO: 64<br>>gi\|84622789\|ref\|YP_450161.1\|avirulence AvrBs3/pth family protein<br>[*Xanthomonas oryzae* pv. *oryzae* MAFF 311018]<br>MDPIRSRTPSPARELLPGPQPDRVQPTADRGGAPPAGGPLDGLPARRTMSRTRLPSPPAPSPAFSAGSFS<br>DPLRQFDPSLLDTSLLDSMPAVGTPHTAAAPAECDEVQSGLRAADDPPPTVRVAVTAARPPRAKPAPRRR<br>AAQPSDASPAAQVDLRTLGYSQQQQEKMKPKVRSTVAQHHEALVGHGFTHAHIVALSQHPAALGTVAVTY |

TABLE 1-continued

Endogenous TALE Polypeptide Sequences

QDIIRALPEATHEDIVGVGKQWSGARTLEALLTEAGELRGPPLQLDTGQLLKIAKRGGVTAVEAVHAWRN
ALTGAPLNLTPDQVVAIASNIGGKQALETVQRLLPVLCQDHGLTPDQVVAIASNNGGKQALETVQRLLPV
LCQDHGLTPDQVVAIASNIGGKQALETVQRLLPVLCQDHGLTPDQVVAIASHGGGKQALETVQRLLPVLC
QDHGLTPDQVVAIASHGGGKQALETVQRLLPVLCQDHGLTPDQVVAIANNVGGKQALETVQRLLPVLCQD
HGLTPDQVVAIASHGGGKQALETVQRLLPVLCQDHGLTPDQVVAIASHDGGKQALETVQRLLPVLCQDHG
LTPDQVVAIASHGGGKQALETVQRLLPVLCQDHGLTPDQVVAIASHDGGKQALETVQRLLPVLCQDHGLT
LDQVVAIASHDGGKKALETVQRLLPVLCQDHGLTPDQVVAIASHDGGKQALETVQRLLPVLCQDHGLTPD
QVVAIASNGGGKQALESIVAQLSRPDPALAALTNDHLVALACLGGRPALDAVKKGLPHAPELIRRVNSRI
GERTSHRVADYAQVVRVLEFFQCHSHPAYAFDEAMTQFGMSRHGLVQLFRRVGVTEFEARCGTLPPASQR
WDRILQASGMKRAKPSPTSAQTPDQASLHAFADSLERDLDAPSPMHEGDQTRASSRKRSRSDRAVTGPSA
QQSFEVRVPEQRDALHLPLSWRVKRPRTRIGGGLPDPGTPIAADLAASSTVMWEQDAAPFAGAADDFPAF
NEEELAWLMELLPQSGSVGGTI

SEQ ID NO: 65
>gi|84622791|ref|YP_450163.1|avirulence AvrBs3/pth family protein
[*Xanthomonas oryzae* pv. *oryzae* MAFF 311018]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKSKVRSTVAQHHEALVGHGFTHAHIVALSQHPAALGTVAVKY
QHIITALPEATHEDIVGVGKQWSGARALEALLTKAGELRGPPLQLDTGQLLKIAKRGGVTAVEAVHASRN
ALTGAPLNLTPDQVVAIASNIGGNQALETVQRLLPVLCQDHGLTPDQVVAIANNNGGKQALETVQRLLPV
LCQAHGLTPDQVVAIASNGGKQALETVQRLLPVLCQAHGLTPNQVVAIASNGGGKQALETVQRLLPVLCQ
AHGLTQDQVVAIASNSGGKQALETVQRLLPVLCQAHGLTPAQVVAIASNNGGKQALETVQRLFPVLCQDH
GLTPDQVVTIANNNGGKQALETVQRLLPVLCQAHGLIPDQVVAIANNNGGKQALETVQRLLPVLCQAHGL
TPAQVVAIASNIGGKQALETVQRLLPVLCRAHGLTPAQVVAIANNNGGKQALETVQRLLPVLCQAHGLTP
DQVVAIASNIGGKQALETVQRLLPVLCQDHGLTPDQVVAIASNGGKQALETVQRLLPVLCQDHGLTPAQV
VAIASHDGGKQALETVQRLLPVLCQDHGLTPDQVVAIASHDGGKQALETVQRLLPVLCQDHGLTLDQVVA
IASNIGGKQALETVQRLLPVLCQDHGLTPDQVVAIASNGGGKQALETVQRLLPVLCQDHGLTPDQVVAIA
SNGGGKQALESIVAQLSRPDPALAALTNDHLVALACLGGRPALDAVKKGLPHAPELIRRVNSRIGERTSH
RVADYAQVVRVLEFFQCHSHPAYAFDEAMTQFGMSRHGLVQLFRRVGVTEFEARCGTLPPASQRWDRILQ
ASGMKRAKPSPTSAQTPDQASLHAFADSLERDLDAPSPMHEGDQTRASSRKRSRSDRAVTGPSAQQSFEV
RVPEQRDALHLPLSWRVKRPRTRIGGGLPDPGTPIAADLAASSTVMWEQDAAPFAGAADDFPAFNEEELA
WLMELLPQSGSVGGTI SEQ ID NO: 66
>gi|84622793|ref|YP_450165.1|avirulence AvrBs3/pth family protein
[*Xanthomonas oryzae* pv. *oryzae* MAFF 311018]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVTY
QHIITALPEATHEDIVGVGKQWSGARALEALFTKAGELRGPPLQLDTGQLLKIAKRGGVTAVEAVHASRN
ALTGAPLNLTPDQVVAIASHDGGKQALETVQRLLPVLCQAHGLTPAQVVAIASHDGGKQALETVQRLLPV
LCQAHGLTPAQVVAIASNNGGKQALETVQRLLPVLCQAHGLTPDQVVAIASNNGGKQALETVQRLLPVLC
QAHGLTPDQVVAIASNSGGKQALETVQRLLPVLCQAHGLTPDQVVAIASNGGGKQALETVQRLLPVLCQA
HGLTPDQVVAIASHDGGKQALETVQRLLPVLCQAHGLTPAQVVAIASSGGKQALETVQRLLPVLCQDHGL
TPDQVVAIASHGGSKQALETVQRLLPVLCQAHGLTPDQVVAIASHDGGKQALETVQRLLPVLCQAHGLTP
AQAVAIASNGGGKQALETVQRLLPVLCQAHGLTPDQVVAIASNGGKQALETVQRLLPVLCQDHGLTPDQV
VAIASHDGGKQALATVQRLLPVLCQAHGLTPDQVVAIASHDGGKQALETVQRLLPVLCQDHGLTPDQVVA
IASHDGGKQALETVQRLLPVLCQDHGLTPDQVVAIASNGGKQALETVQRLLPVLCQDHGLTPDQVVAIAN
NNGGKQALETVQRLLPVLCQDHGLTPDQVVAIASNQVVAIASNIGGKQALETVQRLLPVLCQDHGLTPDQ
VVAIASNNGGKQALETVQRLLPVLCQDHGLTPDQVVAIASHDGGKQALETVQRLLPVLCQDHGLTPAQVV
AIASHIGGKQALETVQRLLPVLCQDHGLTLDQVVAIASNDGSKQALETVQRLLPVLCQDHGLTPDQVVAI
ASHDGGKQALETVQRLLPVLCQDHGLTPDQVVAIASHGGGKQALETVQRLLPVLCQDHGLTSAQVVAIAN
NNGGKQALETVQRLLPVLCQDHGLTPDQVVAIASHGGGKQALETVQRLLPVLCQDHGLTPDQVVAIASNG
GKQALESIVAQLSRPDPALAALTNDHLVALACLGGRPALDAVKKGLPHAPELIRRINRRIPERTSHHVPD
LAHVVRVLGFFQSHSHPAQAFDDAMTQFGMSRNGLVQLFRRVGVTELEARGGTLPPASQRWDRILQASGM
KRAKPSPTSAQTPDQASLHAFADSLERDLDAPSPMHEGDQTGASSRKRSRSDRAVTGPSAQHSFEVRVPE
QHDALHLPLSWRVKRPRTRIGGGLPDPGTPIAADLAASSTVLWEQDAAPFAGAADDFPAFNEEELAWLME
LLPQSGSVGGTI SEQ ID NO: 67
>gi|84622795|ref|YP_450167.1|avirulence AvrBs3/pth family protein
[*Xanthomonas oryzae* pv. *oryzae* MAFF 311018]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEAQSGLRAADDPPPTVRVAVTAARPPRAKPAPRRR
AAQPSDASPAAQVDLRTLGYSQQQQEKIKPKVRSTVARHHEALVGHGFTHAHIVALSQHPAALGTVAVTY
QDIIRALPEATHEDIVGVGKQWSGARALEALLTEAGELRGPPLQLDTGQLLKIAKRGGVTAVKAVHAWRN
ALTGAPLNLTPAQVVAIASHDGGNQALETVQRLLPVLCQDHGLTPDQVVAIASHDGGKQALETVQRLLPV
LCQDHGLTPDQVVAIASHDGGKQALETVQRLLPVLCQDHGLTPAQAVAIASNGGGKQALETVQRLLPVLC
QDHGLTPDQVVAIASNGGKQALETVQRLLPVLCQAHGLTPDQVVAIASNGGGKQALETVQRLLPVLCQAH
GLTPDQVVAIASHDGGKQALETVQRLLPVLCQAHGLTPAQVVAIASSGGKQALETVQRLLPVLCQDHGLT
PDQVVAIASHGGSKQALETVQRLLPVLCQAHGLTLAQVVAIASNIGGKQALETVQRLLPVLCQAHGLTPA
QVMAIASNIGGKQALETVQRLLPVLCQDHGLTPDQVVAIASNNGGKQALETLQRLLPVLCQDHGLTPDQV
VAIASHDGGKQALETVQRLLPVLCQDHGLTPDQVVAIASNNGGKQALETLQRLLPVLCQDHGLTLDQVVA
IASNDGSKQALETVQRLLPVLCQDHGLTPDQVVAIASHDGGKQALETVQRLLPVLCQDHGLTPNQVVAIA
SNIGGKQALETVQRLLLVLCQDHGLTPAQVVAIASHDGGKQALETVQRLLPVLCQDHGLTPDQVVAIASH
GGGKQALETVQRLLPVLCQDHGLTPDQVVAIASNGGGKQALESIVAQLSRPDPALAALTNDHLVALACLG
GRPALDAVKKGLPHAPELIRRINRRIPERTSHRVADLAHVVRVLGFFQSHSHPAQAFDDAMTQFGMSRNG TABLE 1-continued

| Endogenous TALE Polypeptide Sequences |
|---|
| LVQLFRRVGVTELEARCGTLPPASQRWDRILQASGMKRAKPSPTSAQTPDQASLHAFADSLERDLDAPSP<br>MHEGDQTRASSRKRSRSDRAVTGPSAQQSFEVRVPEQRDALHLPLSWRVKRQRTRIGGGLPDPGTPIAAD<br>LAASSTVMWEQDAAPFAGAADDFPAFNEEELAWLMELLPQSGSVGGTI |
| SEQ ID NO: 68<br>>gi\|84623653\|ref\|YP_451025.1\|avirulence AvrBs3/pth family protein<br>[*Xanthomonas oryzae* pv. *oryzae* MAFF 311018]<br>MDPIRSRTPSPARELLPGPQPDRVQPTADRGGAPPAGGPLDGLPARRTMSRTRLPSPPAPSPAFSAGSFS<br>DLLRQFDPSLLDTSLLDSMPAVGTPHTAAAPAEWDEVQSGLRAADDPPPTVRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QHIITALPEATHEDIVGVGKQWSGARALEALLTKAGELRGPPLQLDTGQLLKIAKRGGVTAVEAVHAWRN<br>ALTGAPLNLTPDQVVAIASNIGGKQALETVQRLLPVLCQAHGLNPDQVVAIASNSGGKQALETVQRLLPV<br>LCQDHGLTPDQVVAIASHDGGKQALETVQRLLPVLCQDHGLTPDQVVAIASNGGGKQALETVQRLLPVLC<br>QAHGLNPDQVVAIASNSGGKQALETVQRLLPVLCQAHGLNPDQVVAIASNNGGKQALETVQRLLPVLCQD<br>HGLSPDQVVAIASHDGGKQALETVQRLLPVLCQDHGLTPDQVVAIASNGGKQALETVQRLLPVLCQDHGL<br>TPDQVVAIANNNGGKQALETVQRLLPVLCQDHGLTPDQVVAIANNNGGKQALETVQRLLPVLCQAHGLPP<br>DQVVAIASNIGGKQALETVQRLLPVLCQDHGLTPDQVVAIASNGGGKQALETVQRLLPVLCQDHGLTPDQ<br>VVAIASHDGGKQALETVQRLLPVLCQDHGLTPDQVVAIASNGGGKQALETVQRLLPVLCQDHGLSPDQVV<br>AIASHDGGKQALETVQRLLPVLCQDHGLTLDQVVAIASHDGGKQALETVQRLLPVLCQAHGLTPDQVVAI<br>ASHDGGKQALETVQRLLPVLCQDHGLTPDQVVAIASNGGGKQALESIVAQLYRPDPALAALTNDHLVALA<br>CLGGRPALDAVKKGLPHAPELIRRINRRIPERTSHRVADLAHVVRVLGFFQSHSHPAQAFDDAMTQFGMS<br>RHGLVQLFRRVGVTEFEARYGTLPPASQRWDRILQASGMKRAKPSPTSAQTPDQASLHAFADSLERDLDA<br>PSPMHEGDQTRASSRKRSRSDRAVTGPSAQQSFEVRVPEQRDALHLPLSWRVKRPRTRIGGGLPDPGTPI<br>AADLAASSTVMWEQNADPFAGAADDFPAFNEEELAWLMELLPQSGSVGGTI |
| SEQ ID NO: 69<br>>gi\|84623655\|ref\|YP_451027.1\|avirulence AvrBs3/pth family protein<br>[*Xanthomonas oryzae* pv. *oryzae* MAFF 311018]<br>MDPIRSRTPSPARELLPGPQPDRVQPTADRGGAPPAGGPLDGLPARRTMSRTRLPSPPAPSPAFSAGSFS<br>DLLRQFDPSLLDTSLLDSMPAVGTPHTAAAPAECDEVQSGLRAADDPPPTVRVAVTAARPPRAKPAPRRR<br>AAQPSDASPAAQVDLRTLGYSQQQQEKIKPKVRSTVAQHHEALVGHGFTHAHIVALSQHPAALGTVAVTY<br>QDIIRALPEATHEDIVGVGKQWSGARALEALLTEAGELRGPPLQLDTGQLLKIAKRGGVTAVEAVHAWRN<br>ALTGAPLNLTPDQVVAIASNIGGNQALETVQRLLPVLCQAHGLTPDQVVAIASHGGGKQALETVQRLLPV<br>LCQDHGLTPDQVVAIASNIGGKQALETVQRLLPVLCQDHGLTPDQVVAIASNIGGKQALETVQRLLPVLC<br>QDHGLTPDQVVAIASNIGGKQALETVQRLLPVLCQDHGLTPDQVVAIANNNGGKQALETVQRLLPVLCQD<br>HGLTPDQVVAIASHDGGKQALETVQRLLPVLCQGHGLTPDKVVAIASNSGGKQALETVQRLLPVLCQAHG<br>LTPDKVVAIANNNGGKQALETVQRLLPVLCQDHGLTPDQVVAIASNSGGKQALETVQRLLPVLCQDHGLT<br>PAQVVAIANNNGGKQALETVRRLLPVLCQDHGLTPDQVVAIASHDGGKQALETVQRLLPVLCQDHGLTPD<br>QVVAIANNNGGKQALETVQRLLPVLCQDHGLTQDQVVAIASNIGGKQALETVQRLLPVLCQDHGLTPDQV<br>VAIASHDGGKQALETVQRLLPVLCQDHGLTPAQVVAIANNNGGKQALETVQRLLPVLCQDHGLSPDQVVA<br>IASNIGGKQALETVQRLLPVLCQDHGLTPDQVVAIASNGGGKQALETVQRLLPVLCQDHGLSPDQVVAIA<br>SHDGGKQALETVQRLLPVLCQDHGLTPDQVVAIASNGGGKQALESIVAQLSRPDPALAALTNDHLVALAC<br>LGGRPAMDAVKKGLPHAPELIRRVNSRIGERTSHRVADYAQVVRVLEFFQCHSHPAYAFDEAMTQFGMSR<br>NGLVQLFRRVGVTELEARCGTLPPASQRWDRILQASGMKRAKPSPTSAQTPDQASLHAFADSLERDLDAP<br>SPMHEGDQTRASSRKRSRSDRAVTGPSAQQSFEVRVPEQRDALHLPLSWRVKRPRTRIGGGLPDPGTPIA<br>ADLAASSTVMWEQDAAPFAGAADDFPAFNEEELAWLMELLPQSGSVGGTI |
| SEQ ID NO: 70<br>>gi\|84623658\|ref\|YP_451030.1\|avirulence AvrBs3/pth family protein<br>[*Xanthomonas oryzae* pv. *oryzae* MAFF 311018]<br>MDPIRSRTPSPARELLPGPQPDRVQPTADRGGAPPAGGPLDGLPARRTMSRTRLPSPPAPSPAFSAGSFS<br>DPLRQFDPSLLDTSLFDSMPAVGTPHTAAAPAEWDEAQSALRAADDPPPTVRVAVTAARPPRAKPAPRRR<br>AAQPSDASPAAQVDLRTLGYSQQQQEKIKPKVRSTVAQHHEALVGHGFTHAHIVALSKHPAALGTVAVTY<br>QHIITALPEATHEDIVGVGKQWSGARALEALLTDAGELRGPPLQLDTGQLLKIAKRGGVTAVEAVHASRN<br>ALTGAPLNLTPAQVVAIASNNGGKQALETVQRLLPVLCQAHGLTPAQVVAIASHDGGKQALETVQRLLPV<br>LCQDHGLTPDQVVAIASNSGGKQALETVQRLLPVLCQDHGLTPDQVVAIASNGGGKQALETVQRLLPVLC<br>QDHGLTPDQVVAIASHDGGKQALETVQRLLPVLCQDHGLTPDQLVAIANNNGGKQALETVQRLLPVLCQD<br>HGLTPDQVVAIASNGGKQALETVQRLLPVLCQDHGLTPDQVVAIASNIGGKQALETVQRLLPVLCQAHGL<br>TPAQVVAIASHDGGKQALETMQRLLPVLCQAHGLTPAQVVAIASNSGGKQALETVQRLLPVLCQDHGLTP<br>AQVVAIVSHDGGKQALETVQRLLPVLCQAHGLTPDQVVAIASNNGGKQALETVQRLLPVLCQDHGLTPDQ<br>VVAIASHDGGKQALGTVQRLLPVLCQDHGLTPDQVVAIASNNGGKQALETVQRLLPVLCQDHGLTPDQVV<br>AIASHDGGKQALETVQRLLPVLCQAHGLTPAQVVAIASNNGGKQALETVQRLLPVLCQDHGLTPDQVVAI<br>ANNNGGKQALETVQRLLPVLCQAHGLTPAQVVAIASNNGSKQALETVQRLLPVLCQAHGLTPAQVVAIAS<br>NNGGKQALETVQRLLPVLCQAHGLTPDQVVAIASNNGGKQALETVQRLLPVLCQAHGLTPDQVVAIASNN<br>GGKQALETVQRLLPVLCQAHGLTPDQVVAIASNNGGKQALETVQRLLPVLCQDHGLTPDQVVAIASHDGG<br>KQALETVQRLLPVLCQDHGLTPAQVVAIASNGGGKQALESIVAQLSRPDPALAALTNDHLVALACLGGRP<br>ALDAVKKGLPHAPELIRRVNSRIGERTSHRVADYAQVVRVLEFFQCHSHPAYAFDEAMTQFGMSRNGLLQ<br>LFRRVGVTELEARGGTLPPASQRWDRILQASGMKRAKPSPTSAQTPDQASLHAFADSLERDLDAPSPMHE<br>GDQTRASSRKRSRSDRAVTGPSAQQSFEVRVPEQRDALHLPLSWRVKRPRTRIGGGLPDPGTPMAADLAA<br>SSTVMWEQDAAPFAGAADDFPAFNEEELAWLMELLPQSGSVGGTI |
| SEQ ID NO: 71<br>>gi\|84623784\|ref\|YP_451156.1\|avirulence AvrBs3/pth family protein<br>[*Xanthomonas oryzae* pv. *oryzae* MAFF 311018]<br>MDPIRSRTPSPARELLPGPQPDRVQPTADRGGAPPAGGPLDGLPARRTMSRTRLPSPPAPSPAFSAGSFS<br>DLLRQFDPSLLDTSLLDSMPAVGTPHTAAAPAEWDEAQSGLRAADDPPPTVRVAVTAARPPRAKPAPRRR<br>AAQPSDASPAAQVDLRTLGYSQQQQEKIKPKVRSTVARHHEALVGHGFTHAHIVALSQHPAALGTVAVTY<br>QDIIRALPEATHEDIVGVGKQWSGARALEALLTEARELRGPPLQLDTGQLLKIAKRGGVTAVEAVHAWRN |

TABLE 1-continued

| Endogenous TALE Polypeptide Sequences |
|---|
| ALTGAPLNLTPDQVVAIASNIGGKQALETVQRLLPVLCQDHGLTPDQVVAIASNGGKQALETVQRLLPVL CQAHGLTPDQVVAIASNIGGKQALETVQRLLPVLCQDHGLTPDQVVAIASHGGGKQALETVQRLLPVLCQ DHGLTPDQVVAIASNIGGKQALETVQRLLPVLCQDHGLIPDQVVAIASNIGGKQALETVQRLLPVLCQDH GLTPDQVVAIASNSGGKQALETVQRLLPVLCQAHGLTPDQVVAIASHDGGKQALETVQRLLPVLCQDHGL TPAQVVAIASNNGGKQALETVQRLLPVLCQAHGLTPDQVVAIASHDGGKQALETVQRLLPVLCQDHGLTP AQVVAIASNSGGKQALETVQRLLPVLCQDHGLTPDQVVAIASNGGGKQALETVQRLLPVLCQDHGLTPDQ VVAIASSSGGKQALETVQRLLPVLCQAHGLTPDQVVAIASHDGGKQALETVQRLLPVLCQDHGLTPDQVV AIASNIGGKQALETVQRLLPVLCQDHGLTPDQVVAIASNIGGKQALETVQRLLPVLCQDHGLTPDQVVAI ANNNGGKQALETVQRLLPVLCQDHGLTPDQVVAIASNIGGKQALETVQRLLPVLCQDHGLTPAQVVAIAN NNGGKQALETVQRLLPVLCQDHGLTPDQVVAIASNSGGKQALETVQRLLPVLCQDHGLTPDQVVAIASNG GGKQALESIVAQLSRPDPALAALTNDHLVALACLGGRPALDAVKKGLPHAPELIKRINRRIPERTSHRVA DLPERTSHRVADLAHVVRVLGFFQSHSHPAQAFDDAMTQFGMSRHGLVQLFRRVGVTEFEARCGTLPPAS QRWDRILQASGMKRAKPSPTSAQTPDQASLHAFADSLERDLDAPSPMHEGDQTRASSRKRSRSDRAVTGP STQQSFEVRVPEQHDALHLPLSWRVKRPRTRIGGGLPDPGTPIAADLAASSTVMWEQDAAPFAGAADDFP AFNEEELAWLMELLPQSGSVGGTI |
| SEQ ID NO: 72<br>>gi\|84623786\|ref\|YP_451158.1\|avirulence AvrBs3/pth family protein [*Xanthomonas oryzae* pv. *oryzae* MAFF 311018]<br>MDPIRSRTPSPARELLPGPQPDRVQPTADRGGAPPAGGPLDGLPARRTMSRTRLPSPPAPSPAFPAGSFS DLLRQVDTSLLDSMPAVGTPHTAAAPAEWDEMQSGLRAADDPPPTVRVAVTAARPPRAKPAPRRRAAQPS DASPAAQVDLRTLGYSQQQQEKIKPKVRSTVAQHHEALVGHGFTHAHIVALSQHPAALGTVAVKYQHIIT ALPEATHEDIVGVGKQWSGARALEALLTKAGELRGPPLQLDTGQLLKIAKRGGVTAVEAVHAWRNALTGA PLNLTPDQVVAIASNIGGKQALETVQRLLPVLCQAHGLTPDQVVAIANNNGGKQALETVQRLLPVLCQAH GLTPAQVVAIASNNGGKQALETVQRLLPVLCQDHGLTPDQVVAIASNIGGKQALETVQRLLPVLCQDHGL TPDQVVAIASNIGGKQALETVQRLLPVLCQTHALTPDQVVAIASNIGGKQALETVQRLLPVLCQDHGLTP AQVVAIASHDGGKQALETVQRLLPVLCQDHGLTPDQVVAIASNSGGKQALETVQRLLPVLCQAHGLTLDQ VVAIASHGGGKQALETVQRLLPVLCQDHGLTPDQVVAIASNNGGKQALETVQRLLPVLCQDHGLIPDQVV AIANNNGGKQALETVQRLLPVLCQAHGLTTDQVVTIASNNGGKQALETVQRLLPVLCQDHGLTPDQVVAI ASNIGGKQALETVQRLLPVLCQDHGLTPDQVVAIASNIGGKQALETVQRLLPVLCQDHGLTPDQVVAIAS NGGGKQALETVQRLLPVLCQDHGLTPDQVVAIASHDGGKQALESIVAQLSRPDPALAALTNDHLVALACL GGRPALDAVKKGLPHAPELIRRINRRIPERTSHRVADYAQVVRVLEFFQCHSHPAYAFDEAMTQFGMSRN GLVQLFRRVGVTEFEARCGTLPPASQRWDRILQASGMKRAKPSPTSAQTPDQASLHAFADSLERDLDAPS PMHEGDQTRASSRKRSRSDRAVTGPSTQQSFEVRVPEQRDALHLPLSWRVKRPRTRIGGGLPDPGTPIAA DLAASSTVMWEQDAAPFAGAADDFPAFNEEELAWLMELLPQSGSVGGTI |
| SEQ ID NO: 73<br>>gi\|84623815\|ref\|YP_451187.1\|avirulence AvrBs3/pth family protein [*Xanthomonas oryzae* pv. *oryzae* MAFF 311018]<br>MDPIRSRTPSPARELLPGPQPDRVQPTADRGGTPPAGGPLDGLPVRRTMSRTRLPSPPAPSPAFSAGSFS DLLRQFDPSLLDTSLLDSMPAVGTPHTAAAPAEWDEVQSGLRAADDPPPTVRVAVTAARPPRAKPAPRRR AAQPSDASPAAQVDLRTLGYSQQQQEKIKPKVRSTVAQHHEALVGHGFTHAHIVALSQHPAALGTVAVTY QDIIRALPEATHEDIVGVGKQWSGARALEALLTEARELRGPPLQLDTGQLLKIAKRGGVTAVEAVHAWRN ALTGAPLNLTPDQVVAIASNIGGNQALETVQRLLPVLCQAHGLTPDQVVAIASNGGKQALETVQRLLPVL CQDHSLTPDQVVAIASNIGGKQALETVQRLLPVLCQDHGLTPDQVVAIASNSGGKQALETVQRLLPVLCQ DHGLTPDQVMTIASNNGGKQALETVQRLLPVLCQDHGLTPDQVVTIASNGGGKQALETVQRLLPVLCQAH GLTPDQVVAIANNNGGKQALETVQRLLPVLCQAHGLTPAQVVAIASNSGGKQALETVQRLLPVLCQAHGL TPDQVVAIASNGGKQALETVQRLLPVLCQAHGLTPDQVVAIASNSGGKQALETVQRLLPVLCQAHGLTPD QVVAIANNNGGKQALETVQRLLPVLCQAHGLTPDQVVAIASNSGGKQALETVQRLLPVLCQDHGLTPDQV VAIASNGGKQALETVQRLLPVLCQDHGLTPDQVVAIASHDGGKQALETVQRLLPVLCQDHGLTLDQVVAI ASHGGGKQALETVQRLLPVLCQDHGLTSDQVVAIASHDGGKQALETVQRLLPVLCQDHGLTPDQVVAIAS NIGGKQALETVQRLLPVLCQDHGLTLDQVVAIASHDGGKQALETVQRLLPVLCQDHGLTPDQVVAIASHD GGKQALETVQRLLPVLCQDHGLTPAQVVAIASNGGGKQALESIVAQLSRPDPALAALTNDHLVALACLGG RPALDAVKKGLPHAPELIRRINRRIPERTSHRVADYAQVVRVLEFFQCHSHPAYAFDEAMTQFGMSRHGL VQLFRRVGVTEFEARCGTLPPASQRWDRILQASGMKRAKPSPTSAQTPDQASLHAFADSLERDLDAPSPM HEGDQTRASSRKRSRSDRAVTGPSTQQSFEVRVPEQRDALHLPLSWRVKRPRTRIGGGLPDPGTPIAADL AASSTVMWEQDAAPFAGAADDFPAFNEEELAWLMELLPQSGSVGGTI |
| SEQ ID NO: 74<br>>gi\|84623817\|ref\|YP_451189.1\|avirulence AvrBs3/pth family protein [*Xanthomonas oryzae* pv. *oryzae* MAFF 311018]<br>MDPIRSRTPSPARELLPGPQPDRVQPTADRGGAPPAGGPLDGLPARRTMSRTRLPSPPAPSPAFSAGSFS DLLRQFDPSLLDTSLLDSIPAVGTPHTAAAPAEWDEVQSGLRAADDPPPTVRVAVTAARPPRAKPAPRRR AAQPSDASPAAQVDLRTLGYSQQQQEKIKPKVRSTVAQHHEALVGHGFTHAHIVALSQHPAALGTVAVTY QDIIRALPEATHEDIVGVGKQWSGARALEALLTKAGELRGPPLQLDTGQLLKIAKRGGVTAVEAVHAWRN ALTGAPLNLTPDQVVAIASNIGGNQALETVQRLLPVLCQAHGLTPDQVVAIASHGGGKQALETLQRLLPV LCQDHGLTPDQVVAIASNIGGKQALETVQRLLPVLCQDHGLTPDQVVAIASNGGGKQALETLQRLLPVLC QAHGLTPDQVLAIASHGGGKQALETLQRLLPVLCQDHGLTPAQVVALASHDGGKQALETVQRLLPVLCQD HGLTPAQVVAIASNSGGKQALETVQRLLPVLCQDHGLTPDQVVAIASNGGGKQALETVQRLLPVLCQDHG LTPDQVVAIASHDGGKQALETVQRLLPVLCQDHGLTPDQVVAIANNNGGKQALETVQRLLLVLCQAHGLT PDQVVAIASNGGGKQALETVQRLLPVLCQDHGLTPDQVVAIASHGGGKQALETVQRLLPVLCQDHGLTPD QVVAIASNGGGKQALETVQRLLPVLCQDHGLTPDQVVAIASHDGGKQALETVQRLLPVLCQDHGLTPDQV VAIASHGGGKQALETVQRLLPVLCQDHGLTPDQVVAIASHDGGKQALETVQRLLPVLCQDHGLTPDQVVA IASHDGGKQALETVQRLLPVLCQDHGLTLDQVVAIASNIGGKQALETVQRLLPVLCQDHGLTPDQVVAIA SNSGGKQALETVQRLLPVLCQDHGLTPDQVVAIASHGGGKQALETVQRLLPVLCQDHGLTPDQVVAIASH DGGKQALETVQRLLPVLCQAHGLTPNQVVAIASNIGGKQALETVQRLLPVLCQDHGLTPDQVVAIASNGG KQALETVQRLLPVLCQAHGLTPDQVVAIASNSGGKQALETVQRLLPVLCQDHGLTPNQVVAIASNIGGKQ ALETVQRLLPVLCQDHGLTPDQVVAIASNIGGKQALETVQRLLPVLCQDHGLTLDQVVAIASHDGGKQAL |

TABLE 1-continued

| Endogenous TALE Polypeptide Sequences |
|---|
| ETVQRLLPVLCQAHGLTPDQVVAIASHDGGKQALETVQRLLPVLCQAHGLTLDKVVAIASNGGKQALETV<br>QRLLPVLCQDHGLTPNQVVAIASNSGGKQALETVQRLLPVLCQDHGLTPNQVVAIASNGGKQALESIVAQ<br>LSRPDPALAALTNDHLVALACLGGRPALDAVKKGLPHAPELIRRINRRIPERTSHRVPDLAHVVRVLGFF<br>QSHSHPAQAFDDAMTQFEMSRHGLVQLFRRVGVTEFEARYGTLPPASQRWDRILQASGMKRAKPSPTSAQ<br>TPDQASLHAFADSLERDLDAPSPMHEGDQTGASSRKRSRSDRAVTGPSAQQSFEVRVPEQRDALHLPLSW<br>RVKRPRTRIGGGLPDPGTPIAADLAASSTVMWEQDAAPFAGAADDFPAFNEEELAWLMELLPQSGSVGGT<br>I |
| SEQ ID NO: 75<br>>gi\|84624324\|ref\|YP_451696.1\|hypothetical protein XOO_2667 [*Xanthomonas oryzae* pv. *oryzae* MAFF 311018]<br>MDPIRSRTPSPAREPLPGPQPDRVQPTADRGVSAPAGSPLDGLPARRTVSRTRLPSPPAPLPAFSAGSST<br>DRLRPFDPSLPDTSLFDSMPAVGTPHTEAAPADTSPAAQVDLLTLATVAQHHEALVGHGFTHAHIVALSQ<br>HPAALGTVAVTYQDIITALPEATHEDIVGVGKQLSGARALEALLTKAGELRGPPLQLDTGQLLKIARRGG<br>VTAVEAVHAWRNALTGAPLNLTPDQVVAIASNSGGKQALETVQRLLPVLCQDHGLTPDQVVAIASHDGGK<br>QALETVQRLLPVLCQDHGLTPDQVVAIASNGGGKQALETVQRLLPVLCQDHGLTPDQVVAIASNGGGKQA<br>LETVLCQAHGLTPAQVVAIASNGGGKQALETVQRLLPVLCQAHGLTLDQVVAIASNGGGKQALETVQRLL<br>PVLCQAHGLTPDQVVAIASHDGGKQALETVQRLLPVLCQAHGLTPAQVVAIASHDGGKQALETVQRLLPV<br>LCQAHGLTLDQVVAIASHDGGKQALETVQRLLPVLCQAHGLTLDQVVAIASHDGGKQALETVQRLLPVLC<br>QDHGLTPAQVVAIASNNGGKQALETVQRLLPVLCQDHGLTPDQVVAIASHDGGKQALETMQRLLPVLCQA<br>HGLTPDQVVAIASNGGGKQALETVQRLLPVLCQAHGLTPDQVVAIASHDGGKQALETVQRLLPVLCQDHG<br>LTPAQVVAIASHDGGKQALETVQRLLQVLCQDHGLTPDQVVAIASHDGGKQALETVQRLLPVLCQDHGLT<br>PDQVVAIANNNGGKQALETVQRLLPVLCQDHGLTPDQVVAIASHGGKQALESIVAQLSRRDPALAALTND<br>QLVALACLGGRPAPHSRKRKSHD |
| SEQ ID NO: 76<br>>gi\|84624521\|ref\|YP_451893.1\|avirulence AvrBs3/pth family protein [*Xanthomonas oryzae* pv. *oryzae* MAFF 311018]<br>MDPIRSRTPSPARELLPGPQPDRVQPTADRGGAPPAGGPLDGLPARRTMSRTRLPSPPAPSPAFSAGSFS<br>DLLRQFDPSLLDTSLLDSMPAVGTPHTAAAPAEWDEVQSGLRAADDPPPTVRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QHIITALPEATHEDIVGVGKQWSGARALEALLTEARELRGPPLQLDTGQLLKIAKRGGVTAVEAVHAWRN<br>ALTGAPLNLTPDQVVAIASHDGGKQALETVQRLLPVLCQDHGLTPDQVVAIASHDGGKQALETVQRLLPV<br>LCQDHGLTPAQVVAIASHDGGKQALETVQRLLPVLCQDHGLTPDQVVAIASNSGGKQALETVQRLLPVLC<br>QDHGLTPDQVVAIASNGGKQALETVQRLLPVLCQAHGLTPDQVVAIANNNGGKQALETVQRLLPVLCQAH<br>GLTPAQVVAIASNSGGKQALETVQRLLPVLCQAHGLTPDQVVAIASNGGKQALETVQRLLPVLCQAHGLT<br>PDQVVAIASNSGGKQALETVQRLLPVLCQAHGLTPDQVVAIANNNGGKQALETVQRLLPVLCQAHGLTPD<br>QVVAIASNIGGKQALETVQRLLPVLCQDHGLTPDQVVAIASNNGGKQALETVQRLLPVLCQAHGLTPDQV<br>VAIASNIGGKQALETVQRLLPVLCQDHGLTPDQVVAIASHGGGKQALETVQRLLPVLCQDHGLTPDQVVA<br>IASNIGGKQALETVQRLLPVLCQDHGLIPDQVVAIASNIGGKQALETVQRLLPVLCQDHGLTPDQVVAIA<br>SNSGGKQALETVQRLLPVLCQAHGLTPDQVVAIASHDGGKQALETVQRLLPVLCQDHGLTPAQVVAIASN<br>NGGKQALETVQRLLPVLCQAHGLTPDQVVAIASHDGGKQALETVQRLLPVLCQDHGLTPDKVVAIASNSG<br>GKQALETVQRLLPVLCQDHGLTPDQVVAIASNSGGKQALETVQRLLPVLCQDHGLTPAQVVAIANNNGGK<br>QALETVRRLLPVLCQDHGLTPDQVVAIASHDGGKQALETVQRLLPVLCQDHGLTPDQVVAIANNNGGKQA<br>LETVQRLLPVLCQDHGLTQDQVVAIASNNGGKQALETVQRLLPVLCQAHGLTPDQVVAIANNNGGKQALE<br>TVQRLLPVLCQDHGLSPDQVVAIANNNGGKQALETLQRLLPVLCQTHALTPDQVVAIANNNGGKQALETV<br>QRLLPVLCQDHGLTLDQVVAIASHDGGKQALETVQRLLPVLCQDHGLTPDQVVAIASHDGGKQALETVQR<br>LLPVLCQDHGLTPAQVVAIASNGGGKQALESIVAQLSRPDPALAALTNDHLVALACLGGRPALDAVKKGL<br>PHAPELIRRINRRIPERTSHRVPDLAHVVRVLGFFQSHSHPAQAFDDAMTQFGMSRHGLVQLFRRVGVTE<br>FEARYGTLPPASQRWDRILQASGMKRAKPSPTSAQTPDQASLHAFADSLERDLDAPSPMHEGDQTRASSR<br>KRSRSDRAVTGPSTQQSFEVRVPEQRDALHLPLSWRVKRPRTRIGGGLPDPGTPIAADLAASSTVMWEQD<br>AAPFAGAADDFPAFNEEELAWLMELLPQSGSVGGTI |
| SEQ ID NO: 77<br>>gi\|84624522\|ref\|YP_451894.1\|avirulence AvrBs3/pth family protein [*Xanthomonas oryzae* pv. *oryzae* MAFF 311018]<br>MDPIRSRTPSPARELLPGPQPDRVQPTADRGGAPPAGGPLDGLPARRTMSRTRLPSPPAPSPAFSAGSFN<br>DLLRQFDPSLLDTSLLDSMPAVGTPHTAAAPAEWDEVQSGLRAADDPPPTVRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QHIITALPEATHEDIVGVGKQWSGARALEALLTEARELRGPPLQLDTGQLLKIAKRGGVTAVEAVHAWRN<br>ALTGAPLNLTPDQVVAIASNIGGKQALETVQRLLPVLCQDHGLTPDQVVAIASNGGGKQALETVQRLLPV<br>LCQDHGLTPDQVVAIASNNGGKQALETVQRLLPVLCQDHGLTPDQVVAIASNGGGKQALETVQRLLPVLC<br>QDHGLTPDQVVAIANNKGGKQALETLQRLLPVLCQAHGLTPDQVVAIASNGGGKQALETVQRLLPVLCQD<br>HGLTPAQVVAIASNIGGKQALETVQRLLPVLCQDHGLTPDQVVAIANNNGGKQALETVQRLLPVLCQDHG<br>LTPDQVVTIASNIGGKQALETVQRLLPVLCQDHGLTPDQVVAIANNNGGKQALETVQRLLPVLCQAHGLT<br>PDQVVAIASNIGGKQTLETVQRLLPVLCQDHGLTPDQVVAIANNNGGKQALETVQRLLPVLCQDHGLTPD<br>QVVAIASNSGGKQALETVQRLLPVLCQDHGLTPNQVVAIASNGGGKQALETVQRLLPVLCQDHGLTPDQV<br>VGIASNSGGKQALETVQRLLPVLCQDHGLTPDQVVAIANNNGGKQALETVQRLLPVLCQDHGLTPDQVVA<br>IASNIGGKQALETVQRLLPVLCQDHGLTLDKVVAIASNGGKQALETVQRLLPVLCQDHGLTPDQVVAIAS<br>NSGGKQALETVQRLLPVLCQDHGLTPDQVVAIASNGGGKQALESIVAQLSRPDPALAALTNDHLVALACL<br>GGRPAMDAVKKGLPHAPELIRRVNRRIGERTSHRVADYAQVVRVLEFFQCHSHPAYAFDEAMTQFGMSRH<br>GLVQLFRRVGVTELEARGGTLPPASQRWDRILQASGMKRAKPSPTSAQTPDQASLHAFADSLERDLDAPS<br>PMHEGDQTGASSRKRSRSDRAVTGPSAQQSFEVRVPEQRDALHLPLSWRVKRPRTRIGGGLPDPGTPIAA<br>DLAASSTVMWEQDAAPFAGAADDFPAFNEEELAWLMELLPQSGSVGGTI |

TABLE 1-continued

Endogenous TALE Polypeptide Sequences

SEQ ID NO: 78
>gi|84624523|ref|YP_451895.1|avirulence AvrBs3/pth family protein
[*Xanthomonas oryzae* pv. *oryzae* MAFF 311018]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVKY
QHIITALPEATHEDIVGVGKQWSGARALEALLTEAGELRGPPLQLDTGQLLKIAKRGGVTAVEAVHAWRN
ALTGAPLNLTPDQVVAIASNIGGKQALETVQRLLPVLCQDHGLTPDQVVAIASHGGGKQALETVQRLLPV
LCQDHGLTPDQVVAIASNIGGKQALETVQRLLPVLCQDHGLTPDQVVAIASNIGGKQALETVQRLLPVLC
QDHGLTPDQVVAIASHGGGKQALETVQRLLPVLCQAHGLTPDQVVAIARHDGGKQALETVQRLLPVLCQA
HGLTPDQVVAIANNNGGKQALETVQRLLPVLCQAHGLTPDQVVAIASHDGGKQALETVQRLLPVLCQAHG
LTPDQVVAIASHDGGKQALETVQRLLPVLCQDHGLTPDQVVAIASHDGGKQALETVQRLLPVLCQDHGLT
PDQVVAIASNIGGKQALETVQRLLPVLCQDHGLTPDQVVAIASNIGGKQALETVQRLLPVLCQDHGLTPD
QVVAIANNNGGKQALETVQRLLPVQRLVPVLCQDHGLTQDQVVAIASNIGGKQALETVQRLLPVLYQDHG
LTQDQVVAIASHDGGKQALETVQRLLPVLCQDHGLTPDQVVAIASHDGGKQALETVQRLLPVLCQEHGLT
PDQVVAIASHDGGKQALETVQRLLPVLCQDHGLTPDQVVAIASHGGGKQALGTVQRLLPVLCQDHGLTPD
QVVAIANNNGGKQALETVQRLLPVLCQDHGLTPDQVVAIANNNGGKQALETVQRLLPVLCQAHGLTPDQV
VAIASHDGGKQALETVQRLLPVLCQDHGLTPAQVVAIASNSGGKQALETVQRLLPVLCQDHGLTPAQVVA
IANNNGGKQALETVQRLLPVLCQDHGLTPDQVVAIASHDGGKQALETVQRLLPVLCQDHGLTPDQVVAIA
SNGGGKQALATVQRLLPVLCQAHGLTPDQVVAIASNSGGKQALETVQRLLPVLCQDHGLTPNQVVAIASN
GGKQALESIVAQLSRPDPALAALTNDHLVALACLGGRPALDAVKKGLPHAPELIRRINRRIPERTSHRVP
DLAHVVRVLGFFQSHSHPAQAFDDAMTQFGMSRHGLVQLFRRVGVTEFEARYGTLPPASQRWDRILQASG
MKRAKPSPTSAQTPDQASLHAFADSLERDLDAPSPMHEGDQTRASSRKRSRSDRAVTDPSTQQSFEVRVP
EQRDALHLPLSWRVKRPRTRIGGGLPDPGTPIAADLAASSTVMWEQDAAPFAGAADDFPAFNEEELAWLM
ELLPQSGSVGGTI SEQ ID NO: 79
>gi|84624525|ref|YP_451897.1| avirulence AvrBs3/pth family protein
[*Xanthomonas oryzae* pv. *oryzae* MAFF 311018]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVKY
QHIITALPEATHEDIVGVGKQWSGARALEALLTEARELRGPPLQLDTGQLLKIAKRGGVTAVEAVHAWRN
ALTGAPLNLTPDQVVAIASNIGGKQALETVQRLLPVLCQDHGLTPDQVVAIASHGGGKQALETVQRLLPV
LCQDHGLTPDQVVAIASNIGGKQALETVQRLLPVLCQAHGLTPDQVVAIASNIGGKQALETVQRLLPVLC
QDHGLTPAQVVAIASNSGGKQALETVQRLLPVLCQDHGLTPDQVVAIASHDGGKQALETVQRLLPVLCQD
HGLTPDQVVAIANNNGGKQALETLQRLLPVLCQDHGLTPDQVVAIASHDGGKQALETVQRLLPVLCQDHG
LTPDQVVAIASHDGGKQALETVQRLLPVLCQDHGLTPAQVVAIASHDGGKQALETVQRLLPVLCQDHGLT
PDQVVAIASNSGGKQALETVQRLLPVLCQDHGLTPDQVVAIASNGGKQALETVQRLLPVLCQDHGLTPDQ
VVAIASNGGKQALETVQRLLPVQRLLPVLCQDHGLTQDQVVAIASHDGGKQALETVQRLLPVLCQDHGLT
PDQVVAIASHDGGKQALETVQRLLPVLCQDHGLTPDQVVAIASNSGGKQALETVQRLLPVLCQDHGLTPD
QVVAIASNSGGKQALETVQRLLPVLCQDHGLTPDQVVAIASNNGGKQALETVQRLLPVLCQDHGLTPDQV
VAIANNNGGKQALETVQRLLPVLCQDHGLTPAQVVAIASNIGGKQALETVQRLLPVLCQDHGLTLDQVVA
IASNGGSKQALETVQRLLPVLCQDHGLTPDQVVAIANNNGGKQALETVQRLLPVLCQDHGLTPDQVVAIA
SNIGGKQALETVQRLLPVLCQDHGLTLDQVVAIASNGGKQALETVQRLLPVLCQDHGLTPNQVVAIASNS
GGKQALETVQRLLPVLCQDHGLTPNQVVAIASNGGKQALESIVAQLSRPDPALAALTNDHLVALACLGGR
PALDAVKKGLPHAPELIRRINRRIPERTSHRVPDLAHVVRVLGFFQSHSHPAQAFDDAMTQFEMSRHGLV
QLFRRVGVTEFEARYGTLPPASQRWDRILQASGMKRAKPSPTSAQTPDQASLHAFADSLERDLDAPSPMH
EGDQTGASSRKRSRSDRAVTGPSAQQSFEVRVPEQRDALHLPLSWRVKRPRTRIGGGLPDPGTPIAADLA
ASSTVMWEQDAAPFAGAADDFPAFNEEELAWLMELLPQSGSVGGTI SEQ ID NO: 80
>gi|84625671|ref|YP_453043.1| avirulence AvrBs3/pth family protein
[*Xanthomonas oryzae* pv. *oryzae* MAFF 311018]
MDPIRSRTPSPARELLPGPQPDRVQPTADRGGGAPPAGGPLDGLPARRTMSRTRLPSPPAPSPAFSAGSF
SDLLRQFDPSLLDTSLLDSMPAVGTPHTAAAPAECDEVQSGLRAADDPPPTVRVAVTAARPPRAKPAPRR
RAAQPSDASPAAQVDLRTLGYSQQQQEKIKPKVRSTVAQHHEALVGHGFTHAHIVALSQHPAALGTVAVT
YQDIIRALPEATHEDIVGVGKQWSGARALEALLTKAGELRGPPLQLDTGQLLKIAKRGGVTAVEAVHAWR
NALTGAPLNLTPDQVVAIASNIGGKQALETVQRLLPVLCQAHGLTPDQVVAIASHGGGKQALETVQRLLP
VLCQDHGLTPAQVVAIASNIGGKQALETVQRLLPVLCQDHGLTPDQVMAIANNNGGKQALETVQRLLPVL
CQDHGLTPDQVMAIANNNGGKQALETVQRLLPVLCQDHGLTPDQVVAIASNIGGKQALETVQRLLPVLCQ
DHGLTPTQVMAIANNNGGKQALETVQRLLPVLCQDHGLTPDQVVAIASHDGGKQALETVQRLLPVLCQDH
GLTPAQVVAIASNIGGKQALETVQRLLPVLCQDHGLTPDQVVAIASHDGGKQALETVQRLLPVLCQDHGL
TPDQVVAIASNSGGKQALETVQRLLPVLCQDHGLTPDQVVAIASNSGGKQALETVQRLLPVLCQDHGLTP
AQVVAIASNSGGKQALETVQRLLPVLCQDHGLTPDQVVAIASHDGGKQALETVQRLLPVLCQDHGLTPDQ
VVAIANNNGGKQALETLQRLLPVLCQDHGLTPDQVVAIASHDGGKQALETVQRLLPVLCQDHGLTPDQVV
AIASNGGGKQALETVQRLLPVLCQDHGLTPDQVVAIASHDGGKQALETVQRLLPVLCQDHGLTPAQVVAI
ASHDGGKQALETVQRLLPVLCQDHGLTPDQVVAIASHDGGKQALETVQRLLPVLCQDHGLTPDQVVAIAS
NGGGKQALKTVQRLLPVLCQDHGLTPDQVVAIASNGGGKQALESIVAQLSCPDPALAALTNDHLVALACL
GGRPALDAVKKGLPHAPELIRRINRRIPERTSHRVADLAHVVRVLGFFQSHSHPAQAFDDAMTQFGMSRH
GLVQLFRRVGVTEFEARYGTLPPASQRWDRILQASGMKRAKPSPTSAQTPDQASLHAFADSLERDLDAPS
PMHEGDQTRASSRKRSRSDRAVTDPSAQQSFEVRVPEQHDTLHLPLSWRVKRPRTRIGGGLPDPGTPIAA
DLAASSTVMWEQDAAPFAGAADDFPAFNEEELAWLMELLPQSGSVGGTI TABLE 1-continued

| Endogenous TALE Polypeptide Sequences |
|---|
| SEQ ID NO: 81<br>>gi\|109676285\|gb\|ABG37631.1\| Avr/pth3 [*Xanthomonas oryzae* pv. *oryzae*]<br>MRPGKLCRDHRPLVWRRPCKEVCLMDPIRSRTPSPARELLPGPQPDRVQPTADRGGAPPAGGPLDGLPAR<br>RTMSRTRLPSPPAPSPAFSAGSFSDLLRQFDPSLLDTSLLDSMPAVGTPHTAAAPAEWDEAQSGLRAADD<br>PPPTVRVAVTAARPPRAKPAPRRRAAQPSDASPAAQVDLRTLGYSQQQQEKIKPKVRSTVARHHEALVGH<br>GFTHAHIVALSQHPAGVTYQDIIRALPEATHEDIVGVGKQWSGARALEALLTEAGELRGPPLQLDTGQLL<br>KIAKRGGVTAVKAVHAWRNALTGAPLNLTPAQVVAIASHDGGNQALETVQRLLPVLCQDHGLTPDQVVAI<br>ASNGGGKQALESIVAQLSRPDPALAALTNDHLVALACLGGRPALDAVKKGLPHAPELIRRVNRRIGERTS<br>HRVADYAQVVRVLEFFQCHSHPAQAFDDAMTQFGMSRHGLVQLFRRVGVTEFEARCGTLPPASQRWDRIL<br>QASGMKRAKPSPTSAQTPDQASLHAFADSLERDLDAPSPMHEGDQTRASSRKRSRSDRAVTGPSTQQSFE<br>VRVPEQRDALHLPLSWRVKRPRTRIGGGLPDPGTPMVADLAASSTVMWEQDAAPFAGAADDFPAFNEEEL<br>AWLMELLPQSGSVGGTI |
| SEQ ID NO: 82<br>>gi\|109676287\|gb\|ABG37632.1\| Avr/pth56B [*Xanthomonas oryzae* pv. *oryzae*]<br>MRPGKLCRDHRPLVWRRPCKEVCLMDPIRSRTPSPARELLPGPQPDRVQPTADRGGAPPAGGPLDGLPAR<br>RTMSRTRLPSPPAPSPAFSAGSFSDLLRQFDPSLLDTSLLDSMPAVGTPHTAAAPAEWDEAQSGLRAADD<br>PPPTVRVAVTAARPPRAKPAPRRRAAQPSDASPAAQVDLRTLGYSQQQQEKIKPKVRSTVARHHEALVGH<br>GFTHAHIVALSQHPAALGTVAVTYQDIIRALPEATHEDIVGVGKQWSGARALEALLTEAGELRGPPLQLD<br>TGQLLKIAKRGGVTAVKAVHAWRNALTGAPLNLTPAQVVAIASNIGGKQALETVQRLLPVLCQDHGLTPD<br>QVVAIASNGGGKQALESIVAQLSRPDPALAALTNDHLVALACLGGRPALDAVKKGLPHAPELIRRINRRI<br>PERTSHRVADYAQVVRVLEFFQCHSHPAYAFDEAMTQFGMSRNGLVQLFRRVGVTELEARGGTLPPASQR<br>WDRILQASGMKRAKPSPTSAQTPDQASLHAFADSLERDLDAPSPMHEGDQTGASSRKRSRSDRAVTGPSA<br>QQSFEVRVPEQRDALHLPLSWRVKRPRTRIGGGLPDPGTPIAADLAASSTVMWEQDAAPFAGAADDFPAF<br>NEEELAWLMELLPQSGSVGGTI |
| SEQ ID NO: 83<br>>gi\|124430486\|dbj\|BAF46269.1\| avirulence protein [*Xanthomonas axonopo-dis*<br>pv. *citri*]<br>MDPIRSRTPSPARELLPGPQPDGVQPTADRGVSPPAGGPLDGLPARRTISRTRLPSPPAPSPAFSAGSFS<br>DLLRQFDPSLFNTSLFDSLPPFGAHHTEAATGEWDEVQSGLRAADAPPPTMRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QDMIAALPEATHEAIVGVGKQWSGARALEALLTVAGELRGPPLQLDTGQLLKIAKRGGVTAVEAVHAWRN<br>ALTGAPLNLTPEQVVAIASNIGGKQALETVQALLPVLCQAHGLTPEQVVAIASHDGGKQALETVQRLLPV<br>LCQAHGLTPEQVVAIASNIGGKQALETVQRLLPVLCQAHGLTPEQVVAIASHDGGKQALETVQRLLPVLC<br>QAHGLTPEQVVAIASNIGGKQALETVQRLLPVLCQAHGLTPEQVVAIASNGGGKQALETVQRLLPVLCQA<br>HGLTPDQVVAIASNGGKQALETVQRLLPVLCQAHGLTPAQVVAIASNIGGKQALETVQRLLPVLCQAHGL<br>TPAQVVAIASNGGKQALETVQRLLPVLCQAHGLTPAQVVAIASNIGGKQALETVQRLLPVLCQAHGLTPE<br>QVVAIASHDGGKQALETVQRLLPVLCQAHGLTPEQVVAIASHDGGKQALETVQRLLPVLCQAHGLTPEQV<br>VAIASNIGGKQALETVQRLLPVLCQAHGLTPEQVVAIASHDGGKQALETVQRLLPVLCQAHGLTPEQVVA<br>IASNGGGRPALESIVAQLSRPDPALAALTNDHLVALACLGGRPALDAVKKGLPHAPALIKRTNRRIPERT<br>SHRVADHAQVVRVLGFFQCHSHPAQAFDDAMTQFGMSRHGLLQLFRRVGVTELEARSGTLPPASQRWDRI<br>LQASGMKRAKPSPTSTQTPDQASLHAFADSLERDLDAPSPMHEGDQTRASSRKRSRSDRAVTGPSAQQSF<br>EVRVPEQRDALHLPLSWRVKRPRTSIGGGLPDPGTPTAADLAASSTVMREQDEDPFAGAADDFPAFNEEE<br>LAWLMELLPQ |
| SEQ ID NO: 84<br>>gi\|124430488\|dbj\|BAF46270.1\| avirulence protein [*Xanthomonas smithii*<br>subsp. *citri*]<br>MDPIRSRTPSPARELLPGPQPDGVQPTADRGVSPPAGGPLDGLPARRTISRTRLPSPPAPSPAFSAGSFS<br>DLLRQFDPSLFNTSLFDSLPPFGAHHTEAATGEWDEVQSGLRAADAPPPTMRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QDMIAALPEATHEAIVGVGKQWSGARALEALLTVAGELRGPPLQLDTGQLLKIAKRGGVTAVEAVHAWRN<br>ALTGAPLNLTPEQVVAIASNIGGKQALETVQALLPVLCQAHGLTPEQVVAIASHDGGKQALETVQRLLPV<br>LCQAHGLTPEQVVAIASNIGGKQALETVQRLLPVLCQAHGLTPEQVVAIASHDGGKQALETVQRLLPVLC<br>QAHGLTPEQVVAIASNIGGKQALETVQRLLPVLCQAHGLTPEQVVAIASNGGGKQALETVQRLLPVLCQA<br>HGLTPEQVVAIASHDGGKQALETVQRLLPVLCQAHGLTPDQVVAIASNGGGKQALETVQRLLPVLCQAHG<br>LTPDQVVAIASNGGGKQALETVQRLLPVLCQAHGLTPDQVVAIASNGGGKQALETVQRLLPVLCQAHGLT<br>PEQVVAIASNIGGKQALETVQRLLPVLCQAHGLTPDQVVAIASNIGGKQALETVQRLLPVLCQAHGLTPE<br>QVVAIASNIGGKQALETVQRLLPVLCQAHGLTPEQVVAIASNIGGKQALETVQRLLPVLCQAHGLTPEQV<br>VAIASHDGGKQALETVQRLLPVLCQAHGLTPEQVVAIASNGGGRPALESIVAQLSRPDPALAALTNDHLV<br>ALACLGGRPALDAVKKGLPHAPALIKRTNRRIPERTSHRVADHAQVVRVLGFFQCHSHPAQAFDDAMTQF<br>GMSRHGLLQLFRRVGVTELEARSGTLPPASQRWDRILQASGMKRAKPSPTSTQTPDQASLHAFADSLERD<br>LDAPSPTHEGDQRRASSRKRSRSDRAVTGPSAQQSFEVRVPEQRDALHLPLSWRVKRPRTSIGGGLPDPG<br>TPTAADLAASSTVMREQDEDPFAGAADDFPAFNEEELAWLMELLPQ |
| SEQ ID NO: 85<br>>gi\|124430490\|dbj\|BAF46271.1\| avirulence protein [*Xanthomonas smithii*<br>subsp. *citri*]<br>MDPIRSRTPSPARELLPGPQPDGVQPTADRGVSPPAGGPLDGLPARRTISRTRLPSPPAPSPAFSAGSFS<br>DLLRQFDPSLFNTSLFDSLPPFGAHHTEAATGEWDEVQSGLRAADAPPPTMRVAVTAARPPRAKPAPRRR<br>AAQPSDASPAAQVDLRTLGYSQQQQEKIKPKVRSTVAQHHEALVGHGFTHAHIVALSQHPAALGTVAVKY<br>QDMIAALPEATHEAIVGVGKQWSGARALEALLTVAGELRGPPLQLDTGQLLKIAKRGGVTAVEAVHAWRN<br>ALTGAPLNLTPEQVVAIASNIGGKQALETVQRLLPVLCQAHGLTPEQVVAIASNGGKQALETVQRLLPVL<br>CQAHGLTPEQVVAIASNIGGKQALETVQRLLPVLCQAHGLTPEQVVAIASNIGGKQALETVQRLLPVLCQ<br>AHGLTPAQVVAIASNIGGKQALETVQRLLPVLCQAHGLTPEQVVAIASHDGGKQALETVQRLLPVLCQAH |

TABLE 1-continued

Endogenous TALE Polypeptide Sequences

GLTPDQVVAIASHDGGKQALETVQRLLPVLCQAHGLTPQQVVAIASNGGGKQALETVQRLLPVLCQAHGL
TPEQVVAIASHDGGKQALETVQRLLPVLCQAHGLTPEQVVAIASNGGGKQALETVQRLLPVLCQAHGLTP
EQVVAIASNGGGKQALETVQRLLPVLCQAHGLTPEQVVAIASNGGGKQALETVQRLLPVLCQAHGLTPAQ
VVAIASNGGGKQALETVQRLLPVLCQAHGLTPEQVVAIASNSGGKQALETVQRLLPVLCQAHGLTPEQVV
AIASHDGGKQALETVQRLLPVLCQAHGLTPEQVVAIASHDGGKQALETVQRLLPVLCQAHGLTPEQVVAI
ACNGGGKQALETVQRLLPVLCQAHGLTPEQVVAIASNGGGRPALESIVAQLSRPDPALAALTNDHLVALA
CLGGRPALDAVKKGLPHAPALIKRTNRRIPERTSHRVADHAQVVRVLGFFQCHSHPAQAFDDAMTQFGMS
RHGLLQLFRRVGVTELEARSGTLPPASQRWDRILQASGMKRAKPSPTSTQTPDQASLHAFADSLERDLDA
PSPTHEGDQRRASSRKRSRSDRAVTGPSAQQSFEVRVPEQRDALHLPLSWRVKRPRTSIGGGLPDPGTPT
AADLAASSTVMREQDEDPFAGAADDFPAFNEEELAWLMELLPQ

SEQ ID NO: 86
>gi|124430492|dbj|BAF46272.1| avirulence protein [*Xanthomonas smithii* subsp. *citri*]
MDPIRSRTPSPARELLPGPQPDGVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVYAWRN
ALTGAPLNLTPEQVVAIASNIGGKQALETVQRLLPVLCQAHGLTPDQVVAIASNGGKQALETVQRLLPVL
CQAHGLTPAQVVAIASNIGGKQALETVQRLLPVLCQAHGLTPAQVVAIASNGGKQALETVQRLLPVLCQA
HGLTPAQVVAIASNIGGKQALETVQRLLPVLCQAHGLTPEQVVAIASHDGGKQALETVQRLLPVLCQAHG
LTPEQVVAIASHDGGKQALETVQRLLPVLCQAHGLTPEQVVAIASNGGKQALETVQRLLPVLCQAHGLTP
AQVVAIASNIGGKQALETVQRLLPVLCQAHGLTPEQVVAIASHDGGKQALETVQRLLPVLCQAHGLTPEQ
VVAIASNIGGKQALETVQRLLPVLCQAHGLTPEQVVAIASHDGGKQALETVQRLLPVLCQAHGLTPAQVV
AIASNGGKQALETVQRLLPVLCQAHGLTPDQVVAIASNIGGKQALETVQRLLPVLCQAHGLTPEQVVAIA
SHDGGKQALETVQRLLPVLCQAHGLTPEQVVAIASNIGGKQALETVQRLLPVLCQAHGLTPEQVVAIASH
DGGKQALETVQRLLPVLCQAHGLTPEQVVAIASNGGKQALETVQRLLPVLCQAHGLTPAQVVAIASNIGG
KQALETVQRLLPVLCQAHGLTPEQVVAIASHDGGKQALETVQRLLPVLCQAHGLTPEQVVAIASHDGGKQ
ALETVQRLLPVLCQAHGLTPEQVVAIASNGGGRPALESIVAQLSRPDPALAALTNDHLVALACLGGRPAL
DAVKKGLPHAPALIKRTNRRIPERTSHRVADHAQVVRVLGFFQCHSHPAQAFDDAMTQFGMSRHGLLQLF
RRVGVTELEARSGTLPPASQRWDRILQASGMKRAKPSPTSTQTPDQASLHAFADSLERDLDAPSPTHEGD
QRRASSRKRSRSDRAVTGPSAQQSFEVRVPEQRDALHLPLSWRVKRPRTSIGGGLPDPGTPTAADLAASS
TVMREQDEDPFAGAADDFPVFNEEELAWLMELLPQ SEQ ID NO: 87
>gi|126737478|gb|ABO27067.1| AvrBs3-like effector [*Ralstonia solanacearum*]
LTPQQVVAIASNTGGKRALEAVCVQLPVLRAAPYRLSTEQVVAIASNKGGKQALEAVKAHLLDLLGAPYV
LDTEQVVAIASHNGGKQALEAVKADLLDLRGAPYALSTEQVVAIASHNGGKQALEAVKADLLDLRGAPYA
LSTEQVVAIASHNGGKQALEAVKAQLLDLRGAPYALSTAQVVAIASHNGGKQALEAVKAQLLDLRGAPYA
LSTAQVVAIASNGGGKQALEGIGEQLLKLRTAPYGXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXLSTEQVVAIASSHGGKQALEAVRALFPDLRAAPYA
LSTAQLVAIASNPGGKQALEAVRALFRELRAAPYALSTEQVVAIASNHGGKQALEAVRALFRELRAAPYA
LSTEQVVAIASNHGGKQALEAVRALFRGLRAAPYGLSTAQVVAIASSNGGKQALEAVWALLPVLRATPYD
LNTAQVVAIASHYGGKPALEAVWAKLPVLRGVPYALSTAQVVAIACISGQQALEAIEAHMPTLRQAPHGL
SPERVAAIACIGGRSAVEA SEQ ID NO: 88
>gi|126737480|gb|ABO27068.1| AvrBs3-like effector [*Ralstonia solanacearum*]
LSTAQLVAIASNPGGKQALEAVRAPFREVRAAPYALSPEQVVAIASNHGGKQALEAVRALFRGLRAAPYG
LSTAQVVAIASSNGGKQALEAVWALLPVLRATPYDLSTAQVVAIASHDGGKPALEAVWAKLPVLRGAPYA
LSTAQVVAIACISGQQALEAIEAHMPTLRQAPHS SEQ ID NO: 89
>gi|126738002|gb|ABO27069.1| AvrBs3-like effector [*Ralstonia solanacearum*]
LSTEQVVAIASNKGGKQALEAVKAHLLDLLGAPYVLDTEQVVAIASHNGGKQALEAVKADLLDLRGAPYA
LSTEQVVAIASHNGGKQALEAVKADLLDLRGAPYALSTEQVVAIASHNGGKQALEAVKAQLLDLRGAPYA
LSTEQVVAIASHNGGKQALEAVKAQLLDLRGAPYALSTEQVVAIASSHGGKQALEAVRALFPDLRAAPYA
XXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXLSTAQLVAIASNPGGKQALEAIRALFRELRAAPYA
LSTEQVVAIASNHGGKQALEAVRALFRGLRAAPYGLSTAQVVAVASSNGGKQALEAVWALLPVLRATPYD
LNTAQVVAIASHDGGKPALEAVWAKLPVLRGVPYELSTAQVVAIACISGQQALEVIEAHMPTLRQAPHS SEQ ID NO: 90
>gi|126738004|gb|ABO27070.1| AvrBs3-like effector [*Ralstonia solanacearum*]
LTPQQVVAIASNTGGKRALEAVCVQLPVLRAAPYRLSTEQVVAIASNKGGKQALEAVKAHLLDLLGAPYV
LDTEQVVAIASHNGGKQALEAVKADLLDLRGAPYALSTEQVVAIASHNGGKQALEAVKADLLDLRGAPYA
LSTEQVVAIASHNGGKQALEAVKAQLLDLRGAPYALSTEQVVAIASNNGGKQALEAVKAQLLDLRGAPYA
LSTAQVVAIASNGGGKQALEGIGEQLLKLRTAPYGXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXX TABLE 1-continued Endogenous TALE Polypeptide Sequences LSTAQLVAIASNPGGKQALEAIRALFRELRAAPYALSTEQVVAIASNHGGKQALEAVRALFRGLRAAPYG
LSTAQVVAVASSNGGKQALEAVWALLPVLRATPYDLNTAQVVAIASHDGGKPALEAVWAKLPVLRGVPYE
LSTAQVVAIACISGQQALEVIEAHMPTLRQAPHSLSPERVAAIACIGGRSAVEA SEQ ID NO: 91
>gi|126738006|gb|ABO27071.1| AvrBs3-like effector [*Ralstonia solanacearum*]
LSTEQVVAIASHNGGKQALEAVKADLLDLRGAPYALSTEQVVAIASHNGGKLALEAVKAHLLDLRGAPYA
LSTEQVVAIASHNGGKQALEAVKAQLLDLRGAPYALSTAQVVAIASNGGGKQALEGIGEQLLKLRTAPYG
XXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXX
LSTEQVVAIASNHGGKQALEAVRALFRGLRAAPYGLSTAQVVAVASSNGGKQALEAVWALLPVLRATPYD
LNTAQVVAIASHDGGKPALEAVWAKLPVLRGVPYELSTAQVVAIACISGQQALEAIEAHMPTLRQAPHS SEQ ID NO: 92
>gi|126738008|gb|ABO27072.1| AvrBs3-like effector [*Ralstonia solanacearum*]
LSTEQVVAIASNHGGKQALEAVRALFRGLRAAPYGLSTAQVVAIASSNGGKQALEAVWALLPVLRATPYD
LNTAQVVAIASHDGGKPALEAVWAKLPVLRGVPYALSTAQVVAIACISGQQALEAIEAHMPTLRQAPHS SEQ ID NO: 93
>gi|126738378|gb|ABO27073.1| AvrBs3-like effector [*Ralstonia solanacearum*]
LTPQQVVAIASNTGGKRALEAVCVQLPVLRAAPYRLSTEQVVAIASNKGGKQALEAVKAHLLDLLGAPYV
LDTEQVVAIASHNGGKQALEAVKADLLDLRGAPYALSTEQVVAIASHNGGKQALEAVKADLLELRGAPYA
LSTEQVVAIASHNGGKQALEAVKAHLLDLRGAPYALSTAQVVAIASHNGGKQALEAVKAQLLDLRGAPYA
LSTAQVVAIASNGGGKQALEGIGEQLRKLRTAPYGXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXX
LSTEQVVAIASSHGGKQALEAVRALFPDLRAAPYALSTAQLVAIASNPGGKQALEAVRALFRELRAAPYA
LSTEQVVAIASNHGGKQALEAVRALFRGLRAAPYGLSTAQVVAIASSNGGKQALEAVWALLPVLRATPYD
LNTAQVVAIASHDGGKPALEAVWAKLPVLRGVPYALSTAQVVAIACISGQQALEAIEAHMPTLRQAPHSL
SPERVAAIACIGGRSAVEA SEQ ID NO: 94
>gi|126738380|gb|ABO27074.1| AvrBs3-like effector [*Ralstonia solanacearum*]
LSTEQVVAIASNKGGKQALEAVKAHLLDLLGAPYVLNTEQVVAIASHNGGKQALEAVKADLLDLRGAPYA
LSTEQVVAIASHNGGKQALEAVKADLLELRGAPYAXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXLSTAQVVAIASHDGGKQALEAVGAQLVELRAAPYA
LSTEQVVAIASHDGGKQALEAVGAQLVALRAAPYALSTEQVVAIASSHGGKQALEAVRALLPVLRATPYD
LNTAQVVAIASHDGGKPALEAVRAKLPVLRGVPYALSTAQVVAIACISGQQALEAIEAHMPTLRQAPHS SEQ ID NO: 95
>gi|126738382|gb|ABO27075.1| AvrBs3-like effector [*Ralstonia solanacearum*]
LTPQQVVAIASHDGGKPALEAVWAKLPVLRGVPYALSTAQVVAIACISGQQALEAIEAHMPTLRQAPHSL
SPERVAAIACIGGRSAVEA SEQ ID NO: 96
>gi|139522777|gb|ABO77779.1| PthAW [*Xanthomonas citri* pv. *citri*]
MDPIRSRTPSPARELLPGPQPDRVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQALLPVLCQAHGLTPEQVVAIASNGGGKQALETVQRLLPV
LCQAHGLTPEQVVAIASNGGGKQALETVQRLLPVLCQAHGLTLDQVVAIASNGGGKQALETVQRLLPVLC
QAHGLTPEQVVAIASNSGGKQALETVQRLLPVLCQAHGLTPEQVVAIASHDGGKQALETVQRLLPVLCQA
HGLTPEQVVAIASHDGGKQALETVQRLLPVLCQAHGLTPEQVVAIASNSGGKQALETVQRLLPVLCQAHG
LTPEQVVAIASHDGGKQALETVQRLLPVLCQAHGLTPEQVVAIASNGGGKQALETVQRLLPVLCQAHGLT
PEQVVAIASNCGGKQALETVQRLLPVLCQAHGLTPEQVVAIASNGGGKQALETVQRLLPVLCQAHGLTLD
QVVAIASNGGGKQALETVQRLLPVLCQAHGLTPEQVVAIASNSGGKQALETVQRLLPVLCQAHGLTPDQV
VAIASHDGGKQALETVQRLLPVLCQAHGLTPEQVVAIASHDGGKQALETVQRLLPVLCQAHGLTPEQVVA
IACNGGGKQALETVQRLLPVLCQAHGLTPEQVVAIASNGGGRPALESIVAQLSRPDPALAALTNDHLVAL
ACLGGRPALDAVKKGLPHAPALIKRTNRRIPERTSHRVADHAQVVRVLGFFQCHSHPAQAFDDAMTQFGM
SRHGLLQLFRRVGVTELEARSGTLPPASQRWDRILQASGMKRAKPSPTSTQTPDQASLHAFADSLERDLD
APSPTHEGDQRRASSRKRSRSDRAVTGPSAQQSFEVRVPEQRDALHLPLSWRVKRPRTSIGGGLPDPGTP
TAADLAASSTVMREQDEDPFAGAADDFPAFNEEELAWLMELLPQ SEQ ID NO: 87
>gi|139522812|gb|ABO77780.1| PthA* [*Xanthomonas citri* pv. *citri*]
MDPIRSRTPSPARELLPGPQPDGVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQRLLPVLCQAHGLTPQQVVAIASNGGGKQALETVQRLLPV TABLE 1-continued Endogenous TALE Polypeptide Sequences LCQAHGLTPEQVVAIASNIGGKQALETVQRLLPVLCQAHGLTPEQVVAIASHDGGKQALETVQRLLPVLC
QAHGLTPAQVVAIASNIGGKQALETVQRLLPVLCQAHGLTPEQVVAIASHDGGKQALETVQRLLPVLCQA
HGLTPDQVVAIASHDGGKQALETVQRLLPVLCQAHGLTPQQVVAIASNGGGKQALETVQRLLPVLCQAHG
LTPEQVVAIASHDGGKQALETVQRLLPVLCQAHGLTPEQVVAIASNGGGKQALETVQRLLPVLCQAHGLT
PEQVVAIASNGGGKQALETVQRLLPVLCQAHGLTLDQVVAIASNGGGKQALETVQRLLPVLCQAHGLTPE
QVVAIASNSGGKQALETVQRLLPVLCQAHGLTPDQVVAIASHDGGKQALETVQRLLPVLCQAHGLTPEQV
VAIASNSGGKQALETVQRLLPVLCQAHGLTPEQVVAIACNGGGKQALETVQRLLPVLCQAHGLTPEQVVA
IASNGGGKQALETVQRLLPVLCQAHGLTPEQVVAIASNGGGRPALESIVAQLSRPDPALAALTNDHLVAL
ACLGGRPALDAVKKGLPHAPALIKRTNRRIPERTSHRVADHAQVVRVLGFFQCHSHPAQAFDDAMMQFGM
SRHGLLQLFRRVGVTELEARSGTLPPASQRWDRILQASGMKRAKPSPTSTQTPDQASLHAFADSLERDLD
APSPTHEGDQRRASSRKRSRSDRAVTGPSAQQSFEVRVPEQRDALHLPLSWRVKRPRTSIGGGLPDPGTP
TAADLAASSTVMREQDEDPFAGAADDFPAFNEEELAWLMELLPQ SEQ ID NO: 98
>gi|139522821|gb|ABO77781.1|PthA*2 [*Xanthomonas citri* pv. *citri*]
MDPIRSRTPSPARELLPGPQPDRVQPTADRGVSPPAGGPLDGLPARRTMSRTRLPSPPAPLPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIASNIGGKQALETVQRLLPVLCQAHGLHPGQVVAIASNIGGKQALETVQRLLPV
LCQAHGLTPEQVVAIASNGGKQALETVQRLLPVLCQAHGLTPAQVVAIASNIGGKQALETVQRLLPVLCQ
AHGLTPAQVVAIASNGGKQALETVQRLLPVLCQAHGLTPEQVVAIASNIGGKQALETVQRLLPVLCQAHG
LTPEQVVAIASHDGGKQALETVQRLLPVLCQAHGLTPEQVVAIASHDGGKQALETVQRLLPVLCQAHGLT
PEQVVAIASNGGGKQALETVQRLLPVLCQAHGLTPAQVVAIASNIGGKQALETVQRLLPVLCQAHGLTPE
QVVAIASHDGGKQALETVQRLLPVLCQAHGLTPEQVVAIASNIGGKQALETVQRLLPVLCQAHGLTPEQV
VAIASHDGGKQALETVQRLLPVLCQAHGLTPEQVVAIASHDGGKQALETVQRLLPVLCQAHGLTPAQVVA
IASHDGGKQALETVQRLLPVLCQAHGLTPEQVVAIASNGGGRPALESIVAQLSRPDPALAALTNDHLVAL
ACLGGRPALDAVKKGLPHAPALIKRTNRRIPERTSHRVADHAQVVRVLGFFQCHSHPAQAFDDAMTQFGM
SRHGLLQLFRRVGVTELEARSGTLPPASQRWDRILQASGMKRAKPSPTSTQTPDQASLHAFADSLERDLD
APSPTHEGDQRRASSRKRSRSDRAVTGPSAQQSFEVRVPEQRDALHLPLSWRVKRPRTSIGGGLPDPGTP
TAADLAASSTVMREQDEDPFAGAADDFPAFNEEELAWLMELLPQ SEQ ID NO: 99
>gi|139522849|gb|ABO77782.1|PthC [*Xanthomonas citri* pv. *aurantifolii*]
MDPIRPRTSSPAHELLAGPQPDRVQPQPTADRGGAPPAGSPLDGLPARRTMSRTRLPSPPAPLPAFSAGS
FSDLLCQFDPLLLDTLLFDSMSAFGAPHTEAAPGEADEVQSGLRAVDDPHPTVHVAVTAARPPRAKPAPR
RRAAHTSDASPAGQVDLCTLGYSQQQQDEIKPKARATVAQHHQALMGHGFTRAHIVALSQHPAALGTVAV
KYQAMIAALPEATHEDIVGVGKQWSGARALEALLTVSGELRGPPLQLDTGQLLKIAKRGGVTAVEAVHAW
RNALTGAPLNLTPDQVVAIASHDGGKQALETVQRLLPVLCEQHGLTPDQVVAIASNGGGKQALETVQRLL
PVLCEQHGLTPDQVVAIASHDGGKQALETVQRLLPVLCEQHGLTPDQVVAIASHDGGKQALETVQRLLPV
LCEQHGLTPDQVVAIASNIGGKQALETVQRLLPVLCEQHGLTPDQVVAIASNGGGKQALETVQRLLPVLC
EQHGLTPDQVVAIASNIGGKQALETVQRLLPVLCEQHGLTPAQVVAIASNGGGKQALETVQQLLPVLCEQ
HGLTPDQVVAIASNIGGKQALETVQRLLPVLCQAHGLTPDQVVAIASNIGGKQALETVQRLLPVLCEQHG
LTPDQVVAIASHDGGKQALETVQRLLPVLCEQHGLTPDQVVAIASNGGGKQALETVQRLLPVLCEQHGLT
PDQVVAIASHDGGKQALETVQRLLPVLCEQHGLTPDQVVAIASHDGGKQALETVQRLLPVLRQAHGLTPA
QVVAIASHDGGKQALETVQRLLPVLCEQHGLTPDQVVAIASNGGGKQALETVQRLLPVLCEQHGLTPDQV
VAIASNGGGKQALETVQRLLPVLRQAHGLTPAQVVAIASNGGGRPALESIFAQLSRPDQALAALTNDHLV
ALACLGGRPALEAVKKGLPHAPTLIKRTNRRLPERTSHRVADHAQVARVLGFFQCHSHPAQAFDEAMTQF
GMSRHGLLQLFRRVGVTELEARGGTLPPAPQRWHRILQASGMKRAEPSGASAQTPDQASLHAFADALERE
LDAPSPIDQAGQALASSSRKRSRSESSVTGSFAQQAVEVRVPEQRDALHLPPLSWGVKRPRTRIGGGLPD
PGTPMDADLAASSTVMWEQDADPFAGAADDFPAFNEEEMAWLMELFPQ SEQ ID NO: 100
>gi|145904591|gb|ABP97430.1|AvrHah1 [*Xanthomonas gardneri*]
MDPIRSRTPIPARELLPGPQPDRVQPTADRGVSPPVGGPLDGLPARRTMSQTRLPSPPAPMPAFSAGSFS
DLLRQFDPSLLDTSLFDSVSAFGAPHTEAAPGELDEVQSVLRAADDPQPTVHVVVTAARPPRAKPAPRRR
AAQPSDASPAAQVDLRTLGYSQQQQEKIKSKARSTVEQHHEALVGHGFTHAHIVELSKHPAALGTVAVKY
QAMIAALPEATHEDVVGVGKQWSGARALEALLTVAGELRSPPLQLDTGQLFKIAKRGGVTAVEAVHAWRN
ALTGAPLNLTPEQVVAIASNNGGKQALETVQRLLPVLCQAPHDLTREQVVAIASIGGGKQALETVQRLLP
VLCQAPHCLTREQVVAIASNIGGKQALETVQALLPVLCQAPHCLTREQVVAIASNIGGKQALETVQRLLP
VLCQAPHCLTPEQVVAIASNIGGKQALETVQRLLPVLCQAPHCLTPEQVVAIASHDGGKQALETVQRLLP
VLCQAPHDLTPEQVVAIACHDGGKQALETVQRLLPVLRHAHGLTREQVVAIASNGGGKQALETVQALLPV
LRQAHGLTREQVVAIASNNGGKQALETVQRLLPVLRQAHGLTREQVVAIASNIGGKQALETVQRLLPVLC
QAPHDLTREQVVAIASHDGGKQALETVQRLLPVLCQAPHDLTREQVVAIASHDGGKQALETVQRLLPVLC
QPPHDLTPEQVVAIACHDGGKQALETVQALLPVLRQAHGLTREQVVAIASNGGGKQALESIFAQLSRPDP
ALAALTNDRLVALACIGGRSALNAVKDGLPNALTLITRANSRIPERTSHLVADHTQVVRVLGFFQCHSHP
AQAFDEAMTQFGMSRHGLLQLFRRVGVTELEARSGTLPPASQRWHRMLQASGIKRAKPSSASAQTPDQES
LHAFADSLERELDAPSPMDQAGQVLASSRRKRSRSDRSVTGSSAQQAVEVLVPEQRDALHLPLLSWGVKR
PRTRIGGLLDPGTPMDADLVASSTVVWEQDADPFAGTADDFPAFNEEELALLMELLPH SEQ ID NO: 101
>gi|164523686|gb|ABY60855.1|avirulence protein [*Xanthomonas oryzae* pv. *oryzae*]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAECDEVQSGLRAAYDPPPTVRVAVTAARPPRAKPAPRRR
AAQPSDASPAAQVDLRTLGYSQQQQEKIKPKVRSTVAQHHEALVGHGFTHAHIVALSQHPAALGTVAVKY
QHIITALPEATHEDIVGVGKQWSGARALEALLTKAGELRGPPLQLDTGQLLKIAKRGGVTAVEAVHAWRN
ALTGAPLNLTPDQVVAIANNNGGKQALETVQRLLPVLCQAHGLTPDQVVAIASHDGGKQALETVQRLLPV TABLE 1-continued

| Endogenous TALE Polypeptide Sequences |
|---|
| LCQAHGLTPDQVVAIASHDGGKQALETVQRLLPVLCQDHGLTPDQVVAIASHDGGKQALETVQRLLPVLC<br>QDHGLTPDQVVAIASNIGGKQALETVQRLLPVLCQDHGLTPDQVVAIASNIGGKQALETVQRLLPVLCQD<br>HGLTPDQVVAIANNNGGKQALETVQRLVPVLCQDHGLTQDQVVAIASNIGGKQALETVQRLLPVLYQDHG<br>LTQDQVVAIASHDGGKQALETVQRLLPVLCQDHGLTPDQVVAIASHDGGKQALETVQRLLPVLCQEHGLT<br>PDQVVAIASHDGGKQALETVQRLLPVLCQDHGLTPDQVVAIASHGGGKQALGTVQRLLPVLCQDHGLTPD<br>QVVAIANNNGGKQALETVQRLLPVLCQDHGLTPDQVVAIANNNGGKQALETVQRLLPVLCQAHGLTPDQV<br>VAIASHDGGKQALETVQRLLPVLCQDHGLTPAQVVAIASNSGGKQALETVQRLLPVLCQDHGLTPAQVVA<br>IANNNGGKQALETVQRLLPVLCQDHGLTPDQVVAIASHDGGKQALETVQRLLPVLCQDHGLTLDQVVAIA<br>SNGGKQALETVQRLLPVLCQAHGLTPNQVVAIASNSGGKQALETVQRLLPVLCQDHGLTPNQVVAIASNG<br>GKQALESIVAQLSRPDPALAALTNDHLVALACLGGRPALDAVKKGLPHAPELIRRINRRIPERTSHRVPD<br>LAHVVRVLGFFQSHSHPAQAFDDAMTQFGMSRHGLVQLFRRVGVTEFEARYGTLPPASQRWDRILQASGM<br>KRAKPSPTSAQTPDQASLHAFADSLERDLDAPSPMHEGDQTRASSRKRSRSDRAVTDPSTQQSFEVRVPE<br>QRDALHLPLSWRVKRPRTRIGGGLPDPGTPIAADLAASSTVMWEQDAAPFAGAADDFPAFNEEELAWLME<br>LLPQSGSVGGTI |
| SEQ ID NO: 102<br>>gi\|166710323\|ref\|ZP_02241530.1\|avirulence protein AvrBs3/pth family<br>[*Xanthomonas oryzae* pv. *oryzicola* BLS256]<br>MPAVGTPHTAAAPAEWDEAQSALRAADDPPPTVRVAVTAARPPRAKPAPRRRAAQPSDASPAAQVDLRTL<br>GYSQQQQEKIKPKVRSTVAQHHEALVGHGFTHAHIVALSQHPAALGTVAVTYQHIITALPEATHEDIVGV<br>GKQWSGARALEALLTDAGELRGPPLQLDTGQLVKIAKRGGVTAMEAVHASRNALTGAPLNLTPAQVVAIA<br>SHDGGKQALETVQRLLPVLCQDHGLTRDQVVAIASHDGGKQALETVQRLLPVLCQDHGLPPDQVVAIASH<br>DGGKQALETVQRLLPVLCQDHGLTPDQVVAIASHDGGKQALETVQRLLPVLCQDHGLTPDQVVAIASHDG<br>GKQALETVQRLLPVLCQDHGLTPDQVVAIASNGGGKQALETLQRLLPVLCQAHGLTPAQVVAIASHDGGK<br>QALETVQRLLPVLCQAHGLTPDQVVAIANNNGGKQAVGTVQRLLPVLCQAHGLTPAQVVAIASHDGGKQA<br>LETVQRLLPVLCQAHGLTPDQVVAIASNGGGKQALETVQRLLPVLCQAHGLTLAQVVAIASHGGGKQALE<br>TVQRLLPVLCQAHGLTPDQVVAIANNNGGKQALETVQRLLPVLCQAHGLTPDQVVAIASHDGGKQALETV<br>QRLLPVLCQAHGLTPAQVVAIASNGGKQALETVRRLLPVLCQAHGLTPDQVVAIASNGGGKQALETVQRL<br>LPVLCQDHGLTPDQVVAIASNGGGKQALESIVAQLSRRDPALAALTNDHLVALACLGGRPALDAVKKGLP<br>HAPEFIRRVNRRIAERTSHRVADYAHVVRVLEFFQCHSHPAHAFDEAMTQFGMSRHGLVQLFRRVGVTEF<br>EARYGTLPPASQRWDRILQASGMKRAKPSPTSAQTPDQTSLHAFADSLERDLDAPSPMHEGDQTRASSRK<br>RSRSDRAVTGPSAQQAVEVRVPEQRDALHLPLSWRVKRPRTRIWGGLPDPGTPMAADLAASSTVMWEQDA<br>DPFAGAADDFPAFNEEELAWLMELLPQ |
| SEQ ID NO: 103<br>>gi\|166710324\|ref\|ZP_02241531.1\|avirulence protein [*Xanthomonas oryzae*<br>pv. *oryzicola* BLS256]<br>MPAVGTPHTAAAPAEWDEVQSGLRAADDPPPTVRVAVTAARPPRAKPAPRRRAAQPSDASPAAQVDLRTL<br>GYSQQQQEKIKPKVRSTVAQHHEALVGHGFTHAHIVALSQHPAALGTVAVKYQHIITALPEATHEDIVGV<br>GKQWSGARALEALLTDAGELRGPPLQLDTGQLVKIAKRGGVTAVEAVHASRNALTGAPLNLTPDQVVAIA<br>SNIGGKQALETLQRLLPVLCQAHGLTPDQVVAIANNNGGKQALETVQRLLPVLCQAHGLTPDQVVAIASN<br>IGGKQALETVQRLLPVLCQAHGLTPDQVVAIASNIGGKQALETVQRLLPVLCQDHGLTPDQVVAIASNGG<br>GKQALETVQRLLPVLCQDHGLTPDQVVAIASHDGGKQALETVQRLLPVLCQDHGLTPDQVVAIASNGGGK<br>QALETVQRLLPVLCQDHGLTPDQVVAIANNNGGKQALETVQRLLPVLCQHHGLIPDQVVAIASNIGGKQA<br>LETVQRLLPVLCQHHGLTPDQVVAIASNNGGKQALETVQRLLPVLCQHHGLTPAQVVAIASNIGGKQALE<br>TVQRLLPVLCQDHGLTPDQVMAIANNNGGKQALETVQRLLPVLCQAHGLTPDQVVAIASHDGGKQALEGI<br>VAQLSRPDPALTALTNDHLVALACLGGRPALDAVKKGLPHAPELIRRVNSRIGERTSHRVADYAQVVRVL<br>EFFQCHSHPAHAFDEAMTQFGMSRHGLVQLFRRVGVTELEARCGTLPPASQRWDRILQASGMKRAKPSPT<br>SAQTPDQASLHAFADSLERDLDAPSPMHEGDQTRASSRKRSRSDRAVTGPSAQQAVEVRVPEQRDALHLP<br>LSWRVKRPRTRIGGGLPDPGTPMAADLAASSTVMWEQDADHFAGAADDFPAFNEEELAWLMELLPQ |
| SEQ ID NO: 104<br>>gi\|166710332\|ref\|ZP_02241539.1\|avirulence protein [*Xanthomonas oryzae*<br>pv. *oryzicola* BLS256]<br>MPAVGTPHTAAAPAEWDEVQSGLRAADDPPPTVRVAVTAARPPRAKPAPRRRAAQPSDASPAAQVDLRTL<br>GYSQQQQEKIKPKVRSTVAQHHEALVGHGFTHAHIVALSQHPAALGTVAVKYQHIITALPEATHEDIVGV<br>GKQWSGARALEALLTKAGELRGPPLQLDTGQLLKIARRGGVTAVEAVHAWRNALTGAPLNLTPAQVVAIA<br>SNNGGKQALETVQRLLPVLCQAHGLTPDQVVAIASHDGGKQALETVQRLLPVLCQAHGLTPDQVVAIASN<br>IGGKQALETVQRLLPVLCQAHGLTPDQVVAIANNKGGKQALETVQRLLPVLCQAHGLTPDQVVAIASHDG<br>GKQALETVQRLLPVLCQAHGLTPAQVVAIASHDGGKQALETVQRLLPVLCQAHGLTPAQVVAIASHDGGK<br>QALETVQRLLPVLCQAHGLTPAQVVAIASNGGGKQALETVQRLLPVLCQDHGLTLDQVVAIASNIGGKQA<br>LETVQRLLPVLCQDHGLTLDQVVAIASNNGGKQALETVQRLLPVLCQAHGLIPAQVVAIASHDGGKQALE<br>TVQRLLPVLCQDHGLIPAQVVAIASHDGGKQALETVQRLLPVLCQDHGLTPAQVVAIASNGGGKQALESI<br>VAQLSRPDPALAALTNDHLVALACLGGRPALDAVKKGLPHAPELIRRVNRRIAERTSHRVADLAHVVRVL<br>EFFQCHSHPAHAFDEAMTQFGMSRHGLVQLFRRVGVTELEASGGTLPPASQRWHRILQASGMKRAKPSPT<br>SAQTPDQASLHAFADSLERDPDAPSPMHEGDQTRASSRKRSRSDRAVTGPSAQQAVEVRVPEQRDALHLP<br>LSWSVKRPRTRIGGGLPDPGTPMAADLAASSTVMWEQDADPFAGAADDFPAFNEEELAWLMELLPQ |
| SEQ ID NO: 105<br>>gi\|166711321\|ref\|ZP_02242528.1\|avirulence protein AvrBs3/pth family<br>[*Xanthomonas oryzae* pv. *oryzicola* BLS256]<br>MYQHIITALPEATHEDIVGVGKQLSDARALEALLTKAGELRGPPLQLDTGQLLKIARRGGVTAVEAVHAW<br>RNALTGAPLNLTPDQVVAIASNSGGKQALETVQRLLPVLCQDHGLTPDQVVAIASNDGGKQALETVQRLL<br>PVLCQDHGLTPDQVVAIASHGGGKQALEAVQRLLPVLCQDHGLTPDQVVAIASHGGGKQALETVQRLLPV<br>LCQDHGLTPDQVVAIASHGGGKQALEAVQRLLPVLCQAHGLTPDQVVAIASNGGGKQALETVLRQAHGLT<br>PDQVVAIASHGGGKQALETVQRVLPVLCQAHGLTLDQVAAIASHGGGKQALETVQRLLPVLCQAHGLTPD<br>QVVAIASHDGGKQALETVQRLLPVLCQAHGLTPNQVVAIASHDGGKQALETVQRLLPVLCQAHGLTLDQV<br>VAIASHDGGKQALETVQRLLPVLCQTHGLTPAQVVAIASNNGGKQALETVQRLLPMLCQAHGLTPAQVVA |

TABLE 1-continued

Endogenous TALE Polypeptide Sequences

IASNNGGKQALETVQRLLPMLCQDHGLTPDQVVAIASHDSGKQALETMQRLLPVLCQDHGLTPDQVVAIA
SHGGGKQALETVQRLLPVLCQDHGLTPDQVVAIASHHGGKQALETVQRLLPVLCQDHGLTPDQVVAIASH
GGKQALETVQRLLPVLCQDHGLTPDQVVAIASHGGKQALETVQRLLPVLCQDHGLTPDQVVAIASNNGGK
QALETVRRLLQVLCQDHGLTPDQVVAIASHDGGKQALETVQRLLPVLCQAHGLTPDQVVAIASHGGKQAL
ESIVAQLSRRDPALAALTKDQLVALACFGGRPAPHSRKRKSHD

SEQ ID NO: 106
>gi|166711327|ref|ZP_02242534.1|avirulence protein AvrBs3/pth family
[*Xanthomonas oryzae* pv. *oryzicola* BLS256]
MPAVGTPHTAAAPAEWDEAQSGLRAADDPPPTVRVAVTAARPPRAKPAPRRRAAQPSDASPAAQVDLSTL
GYSQQQQEKIKPNVRSTVAQHHEALVGHGFTHAHIVALSQHPAALGTVAVTYQHIITALPEATHEDIVGV
GKQWSGARALEALLADAGELRGPPLQLDTGQLLKIAKRGGVTAVEAVHASRNALTGAPLNLTPAQVVAIA
SNNGGKQALETVQRLLPVLCQAHGLTPDQVVAIASNNGSKQALETVQRLLPVLCQDHGLTPDQVVAIASN
DGGKQALETVQRLLPVLCQDHGLSPDQVVTIASNGGKQALETLQRLLPVLCQDHGLTPDQVVAIASNSGG
KQALETVQRLLPVLCQDHGLTPDQVVAIASNSGGKQALETVQRLLPVLCQAHGLTPDQVVAIASYGGGKQ
ALETVQRVLPVLCQDHGLTPDQVVAIASNIGGKQALETLQRLLPVLCQDHGLTPDQVVAIANSNGGKQAL
ETVQRLLPVLCQDHGLTPDQVVAIASHDGGKQALETVQRLLPVLCQDHGLTPDQVVAIASHDGSKQALET
VQRLLPVLCQDHGLTPDQVVAIASNGGGKQALETVQRLLPVLCQDHGLTPDQVVAIASHDGGKQALETVQ
RLLPVLCQDHGLTPAQVVAIASNSGGKQALETVQRLLTVLCQDHGLTTDQVVAIANNNGGKQALETVQRL
LPVLCQDHGLTTDQVVAIASHDGGKQALETVQRLLPVLCQDHGLTPAQVVAIASNGGGKQALESIVAQLS
RPDPALAALTNDHLVALACLGGRPALDAVKKGLPHAPEFIRRVNRRIAERTSHRVADYAQVVRVLEFFQC
HSHPAHAFDEAMTQFGMSRQGLVQLFRRVGVTELEARCGTLPPASQRWDRILQASGMKRGKPSPTSAQTP
DQASLHGFADSLERDLDAPSPMHEGDQTRASSRKRSRSDHAVTGPSAQQAVEVRVPEQRDALHLPLSWSV
KRPRTRIGGGLPDPGTPMAADLAASSTVMWEQDAAPFAGAADDFPAFNEEELAWLMELLPQ SEQ ID NO: 107
>gi|166711328|ref|ZP_02242535.1|hypothetical 125K protein [*Xanthomonas
oryzae* pv. *oryzicola* BLS256]
MQSALRAADDPPPTVRVAVTAARPPRAKPAPRRRAAQPSDASPAAQVDLRTLGYSQQQQEKIKPNVRSTV
AQHHEALVGHGFTHAHIVALSQHPAALGTVAVTYQHIITALPEATHEDIVGVGKQWSGARALEALLTKAG
ELRGPPLQLDTGQLLKIAKRGGVTAVEAVHASRNALTGAPLNLTTDQVVAIASHDGGKQALETVQRLLPV
LCQAHGLTPDQVVAIASHDGGKQALETVQRLLPVLCQDHGLTPDQVVAIASNGGGKQALETVQRLLPVLC
QDHGLTPDQVVAIASNIGGKQALETVQRLLPVLRQDHGLTPDQVVAIASHGGGKQALETVQRLLPVLCQD
HGLTPAQVVAIASHDGGKQALETVQRLLPVLCQDHGLTPDQVVATASHGGGKQALETVQRLLPVLCQDHG
LTPDQVVAVASNIGGKQALETVQRLLPVLCQAHGLTPDQVVAIASHDGGKQALETVQRLLPVLCQAHGLT
PDQVVAIANNNGGKQALETVQRLLPVLCQDHGLTPAQVVAIASHDGGKQALETVQRLLPVLCQDHGLTPD
QVVAIASHGGGKRALETVQRLLPVLCQAHGLTPAKVVAIASHGGGKQALETVQRLLPVLCQDHGLTPDQV
VAIASHGGGKQALETVQRLLPVLCQDHGLTLDQVVAIASNGGSKQALETVQRLLPVLCQDHGLTPDQVVA
IASNIGGKQALETVQRLLPVLCQDHGLTPAQVVAIASNGGGKQALESIVAQLSRPDPALAALTNDHLVAL
ACLGGRPALDAVKKGLPHAPELIRKINRRIPERTSHRVADLPERTSNRVADLAHVVRVLGFFQSHSHPAQ
AFDDAMTQFGMSRHGLVQFFRRVGVTELEARCGTLPPASQRWDRILQASGMKRAEPSPTSAQTPDQASLH
AFADSLERDLDAPSPMHEGDQTRASSRKRSRSDRAVTAPSAQQAVEVRVPEQRDALHLPLSWSVKRPRTR
IGGGLPDPGTPMAADLAASSTVMWEQDADHFAGAADDFPAFNEEELAWLMELLPQ SEQ ID NO: 108
>gi|166711329|ref|ZP_02242536.1|avirulence protein AvrBs3/pth family
[*Xanthomonas oryzae* pv. *oryzicola* BLS256]
MPAVGTPHTAAAPAEWDEAQSGLRAADDPPPTVRVAVTAARPPRAKPAPRRRAAQSSDASPAAQVDLRTL
GYSQQQQEKIEPNVRSTVAQHHEALVGHGFTHAHIVALSQHPAALGTVAVTYQHIITALPEATHEDIVGV
GKQWSGARALEALLTKAGELRGPPLQLDTGQLVKIAKRGGVTAVEAVHAWRNALTGAPLNLTPDQVVAIA
SNIGGKQALETLQRLLPVLCQDHGLTPDQVVAIANNNGGKQALETVQRLLPVLCQAHGLTPDQVVAIASN
IGGKQALETVQRLLPVLCQDHGLTPDQVVAIASNIGGKQALETVQRLLPVLCRDHGLTPDQVVAIASNIG
GKQALETVQRLLPVLCQAHGLTPDQVVAIASNIGGKQALETVQRLLPVLCQDHGLTPDQVVAIASNGGKQ
ALETVQRLLPVLCQDHGLTPDQVVAIASNIGGKQALETVQRLLPVLCQDHGLTPDQVVAIASNGGGKQAL
ETVQRLLPVLCQDHGLTPDKVVAIANNNGGKQALETVQRLLPVLCQDHGLTPAQVVTIASNNGGKQALET
VQRLLPVLCQDHGLTPAQVVTIASNNGGKQALETVQRLLPVLCQDHGLTPDQVVAIASNIGSKQALETVQ
RLLPVLRQDHGLTPAQVVAIASNSGGKQALETVQRLLPVLCQDHGLTPDQVVAIASNGGGKQALETVQRL
LPVLCQDHGLTPDQVVAIASNGGGKQALESIVAQLSRPDPALAALTNDHLVALACLGGRPALDAVKKGLP
HAPELIRRVNRRIGERTSHRVADYAQVVRVLEFFQCHSHPAHAFDEAMTQFGMSRHGLVQLFRRVGVTEF
EARYGTLPPASQRWDRILQASGMKRAKPSPTSAQTPDQASLHAFADSLERDLDAPSPMHEGDQTRASSRK
RSRSDRAVTDPSAQQAVEVRVPEQRDALHLPLSWSVKRLRTRIGGGLPDPGTPMAADLAASSTVMWEQDA
DPFAGAADDFPAFNEEELAWLMELLPQ SEQ ID NO: 109
>gi|166711330|ref|ZP_02242537.1|avirulence protein AvrBs3/pth family
[*Xanthomonas oryzae* pv. *oryzicola* BLS256]
MPAVGTPHTAAAPAEWDEVQSALRAADDPPPTVRVAVTAARPPRAKTAPRRRAAQSSDASPAAQVDLRTL
GYSQQQQEKIKPNVRSTVAQHHEALVGHGFTHAHIVALSQHPAALGTVAVTYQHIITALPEATHEDIVGV
GKQWSGARALEALLTKAGELRGPPLQLDTGQLLKIAKRGGVTAVEAVHASRNALTGAPLNLTPAQVVAIA
SNIGGKQALETLQRLLPVLCQDHGLTPDQVVAIASHGGGKQALETVQRLLPVLCQDHGLTPDQVVAIASN
GGKQALETVQRLLPVLCQDHGLTPDQVVAIANNNGGKQALETLQRLLPVLCQAHGLTPDQVVTIASNGGK
QALETVQRLLPVLCQDHGLTPDQVVAIASHDGGKQALETVQRLLPVLCQAHGLTPDQVVAIASHGGGKQA
LETVQRLLPVLCQDHGLTPDQVVAIASHDGGKQALETMQRLLPVLCQDHGLTPAQVVAIASNNGGKQALE
TVQRLLPVLCQDHGLTPDQVVAIASHDGGKQALETVQRLLPVLCQDHGLTPDQVVSIANNKGGKQALETV
QRLLPVLCQAHGLTPGQVVAIASHGGGKRALETVQRLLPVLCQDHGLTLAQVVAIANNNGGKQALETVQR
LLPVLCQDHGLTLAQVVAIANNNGGKQALETVQRLLPVLCQAHGLTPDQVVAIASNGGGKQALETVQRLL
PVLCQDHGLTPAQVVAIASHDGGKQALEGIVAQLSRPDPALTALTNDHLVALACLGGRPALDAVKKGLPH
APELIRRVNSRIPERTSHHVADLAQVVRVLEFFQCHSHPAHAFDEAMTQFGMSRHGLVQLFRRVGVTEFE TABLE 1-continued Endogenous TALE Polypeptide Sequences ARYGTLPPASQRWDRILQASGMKRAEPSPTSAQTPDQASLHAFADSLERDLDAPSPMHEGDQTRASSRKR
SRSDRAVTDPSAQQSFEVRVPEQRDALHLPLSWSVKRPRTRIWGGLPDPGTPMAADLAASSTVMWEQDAD
PFAGAADDFPAFNEEELAWLMELLPQ SEQ ID NO: 110
>gi|166711331|ref|ZP_02242538.1|avirulence protein AvrBs3/pth family [*Xanthomonas oryzae* pv. *oryzicola* BLS256]
MPAVGTPHTAAAPAEWDEAQSVLRAADDPPPTVRVAVTAARQPRAKPAPRRRAAQPSDASPAAQVDLRTL
GYSQQQQEKIKPNVRSTVAQHHEALVGHGFTHAHIVALSQHPAALGTVAVTYQHIITALPEATHEDIVGV
GKQWSGARALEALLTKAGELRGPPLQLDTGQLLKIARRGGVTAVEAVHASRNALTGAPLNLTTDQVVAIA
SHDGGKQALETVQRLLPVLCQAHGLTPAQVVTIASHDGGKQALETVQRLLPVLCQDHGLTPAQVVAIASN
NGGKQALETVQRLLPVLCQDHGLTPAQVVAIASNNGGKQALETVQRLLPVLCQDHGLTPDQVMAIASNGG
GKQALETVQRLLPVLCQDHGLTPDQVVAIASNGGKQALETVQRLLPVLCQDHGLPPAQVVAIASHDGGKQ
ALETVQRLLPVLCQDHGLTPAQVVAIASNIGGKQALETVQRLLPVLCQDHGLTLDQVVAIASNGGSKQAL
ETVQRLLPVLCQAHGLTPDQVVAIASHDGGKQALETVQRLLPVLCQDHGLTPDQVVTIASNGGGKQALET
VQRLLPVLCQDHGLTPDQVVTIASNSGGKQALETVQRLLPVLCQDHGLTPDQVMAIASHDGGKQALETVQ
RLLPVLCQDHGLTPDQVVAIASHAGGKQALETVQRLLPVLCQDHGLTPDQVVAIASNDGGKQALETVQRL
LPVLCQDHGLTPDQVVAIASNGGKQALETVQRLLPVLCQDHGLTPDQVVAIASNDGGKQALETVQRLLPV
LCQDHGLTPDQVVAIANNNGGKQALETVQRLLPVLCQDHGLTPDQVVAIASHDGGKQALETVQRLLPVLC
QTHGLTPAQVVAIASNNGGKQALETVQRLLPVLCQDHGLTPDQVVAIASNNGGKQALETVQRLLPVLCQD
HGLTLDQVVAIASHDGGKQALETVQRLLPVLCQDHGLTPDQVVAIASHDGGKQALETVQRLLPVLCQDHG
LTPDQVVAIASNGGKQALETVQRLLTVLCQDHGLTPAQVVAIANNNGGKQALETVQRLLPVLCQDHGLTP
AQVVAIASNGGGKQALETVQRLLPVLCQDHGLTPAQVVAIASHDGGKQALEGIVAQLSRPDPALTALTND
HLVALACLGGRPALDAVKKGLPHAPELIRRVNRRIPERTSHHVADLAQVVRVLEFFQCHSHPAHAFDEAM
TQFGMSRHGLVQLFRRVGVTEFEARYGTLPPASQRWDRILQASGMKRAEPSPTSAQTPDQASLHAFADSL
ERDLDAPSPMHEGDQTRASSRKRSRSDRAVTAPSAQQSFEVRVPEQRDALHLPLSWSVKRPRTRIGGGLP
DPGTPMAADLAASSTVMWEQDADHFAGAADDFPAFNEEELAWLMELLPQ SEQ ID NO: 111
>gi|166711332|ref|ZP_02242539.1|avirulence protein [*Xanthomonas oryzae* pv. *oryzicola* BLS256]
MQRLLPVLCQDHGLTPDQVVAIASHDGGKQALETVQRLLPVLCQDHGLTPDQVVAIANNNGGKQALETVQ
RLLPVLCQDHGLTPAQVVAIASNNGGKQALETVQRLLPVLCQDHGLTLDQVVAIASNGGSKQALETAQRL
LPVLCQAHGLTPDQVVAIASHDGGKQALETAQRLLPVLCQAHGLTPAQVVAIANNNGGKQALETVQRLLP
VLCQDHGLTPAQVVAIASNNGGKQALETVQRLLPVLCQDHGLTLDQVVAIASNGGGKQALETVQRLLPVL
CQDHGLTTDQVVAIANNNGGKQALETVQRLLPVLCQDHGLTPNQVVAIASNIGGKQALETVQRLLPVLCQ
DHGLTPAQVVAIASNGGGKQALESIVAQLSRPDPALAALTNDHLVALACLGGRPALDAVKKGLPHAPELI
RRVNRRIPERTSHRVADLAQVVRVLEFFQCHSHPAHAFDEAMTQFGMSRHGLVQLFRRVGVTEFEARYGT
LPPASQRWDRILQASGMKRAEPSPTSAQTPDQASLHAFADSLERDLDAPSPMHEGDQTRASSRKRSRSDR
AVTDPSAQQSFEVRVPEQRDALHLPLSWSVKRPRTRIGGGLPDPGTPMAADLAASSTVMWEQDADHFAGA
ADDFPAFNEEELAWLMELLPQ SEQ ID NO: 112
>gi|166711333|ref|ZP_02242540.1|avirulence protein [*Xanthomonas oryzae* pv. *oryzicola* BLS256]
MPAVGTPHTAAAPAEWDEAQSGLRAADDPPPTVRVAVTAARPPRAKPAPRRRAAQPSDASPAAQVDLRTL
GYSQQQQEKIKPNVRLTVAQHHEALVGHGFTHAHIVALSQHPAALGTVAVTYQHIITALPEATHEDIVGV
GKQWSGARALEALLTKAGELRGPPLQLDTGQLLKIAKRGGVTAVEAVHASRNALTGAPLNLTPAQVVAIA
SNIGGKQALETVQRLLPVLCQDHGLTPDQVVAIASHGGGKQALETVQRLLPVLCQDHGLTPDQVVAIASN
IGGKQALETVQRLLPVLCQDHGLTPAQVVAIASNGGKQALETLQRLLPVLCQDHGLTPDQVVAIASHNGG
KQALETVQQLLPVLCQDHGLTPDQVVAIASNGGGKQALETVQRLLPVLCQDHGLTPDQVVAIASNNGGKQ
ALETVQRLLPVLCQDHGLTPDQVVATASNDGGKQALETVQRLLPVLCQDHGLTPDQVVAIASHDGGKQAL
ETVQRLLPVLCQDHGLTPDQVVAIASNGGGKQALETVQRLLPVLCQDHGMTPDQVVAIASHDGGKQALET
VQRLLPVLCQDHGLTPDQVVAIASNIGGKQALETVQRLLPVLCQDHGLTPAQVVAIASHGGGKQALETVQ
RLLPVLCQDHGLPPDQVVAIASHGGSKQALETVQRLLPVLCQDHGLTPDQVVAIASHDGGKQALETVQRL
LPVLCQDHGLTPDQVVAIASNNGGKQALETVQRLLPVLCQDHGLTPAQVVAIASHDGSKQALETVQRLLP
VLCQDHGLTPDQVVAIASHHGGKQALETVQRLLPVLCQDHGLTPDQVVAIASNGAASRRWRRCSGCCRCC
ARTMA SEQ ID NO: 113
>gi|166711339|ref|ZP_02242546.1|avirulence protein AvrBs3/pth family [*Xanthomonas oryzae* pv. *oryzicola* BLS256]
MQSALRAADDPPPTVRVAVTAARPPRAKPAPRRRAAQPSDASPAAQVDLRTLGYSQQQQEKIKPKVRSTV
AQHHEALVGHGFTHAHIVALSQHPAALGTVAVTYQHIITALPEATHEDIVGVGKQWSGARALEALLTDAG
ELRGPPLQLDTGQLVKIAKRGGVTAVEAVHASRNALTGAPLNLTPAQVVAIASHDGGKQALETVQRLLPV
LCQAHGLTPNQVVAIASHDGGKQALETVQRLLPVLCQDHGLTPDQVVAIASNCGGKQALETVQRLLPVLC
QAHGLTPDQVVAIASHDGGKQALETVQRLLPVLCQDHGLTPDQVVAIASNCGGKQALETVQRLLPVLCQD
HGLTPDQVVAIASNGGGKQALETVQRLLPVLCQDHGLTPAQVVAIASHDGGKQALETVQRLLPVLCQAHG
LTPDQVVTIASHHGGKQALETVQRLLPVLCQDHGLTPDQVVAIASHDGGKQALETVQRLLPVLCQDHGLT
LAQVVAIASNIGGKQALETVQRLLPVLCQAHGLTPDQVVAIASNGGGKQALETVQRLLPVLCQAHGLSPD
QVVAIASNGGKQALETVQRLLPVLCQDHGLTPAQVLAIASNSGGKQALETVQRLLTVLCQDHGLTTDQVV
AIASNGGKQALETVQRLLPVLCQAHGLTTDQVVAIASHDGGKQALETVQRLLPVLCQAHGLTPAQVVAIA
SHDGGKQALETVQRLLPVLCQDHGLTPDQVVAIASNSGGKQALETVQRLLTVLCQDHDLTPDQVVAIASN
IGGKQALETVQRLLTVLCQDHGLTPDQVVAIASHGGGKQALETVQRLLPVLCQDHGLTPDQVVAIASHDG
GKQALETVQRLLPVLCQDHGLTPDQVVAIASNGGGKQALESIVAQLSRRDPALAALTNDHLVALACLGGR
PALDAVKKGLPHAPEFIRRVNSRIAERTSHRVADYAHVVRVLEFFQCHSHPAQAFDDAMTQFGMSRHGLV
QLFRRVGVTEFEARYGTLPPASQRWDRILQASGMKRAKPSPTSAQTPDQTSLHAFADSLERDLDAPSPMH TABLE 1-continued Endogenous TALE Polypeptide Sequences EGDQTRASSRKRSRSDRAVTGPSAQQAVEVRVPEQRDALHLPLSWSVKRPRTRIGGGLPDPGTPIAADLA
ASSTVMWEQDVDHFAGAADDFPAFNEEELAWLRELLPQ SEQ ID NO: 114
>gi|166711455|ref|ZP_02242662.1|hypothetical 125K protein [*Xanthomonas oryzae* pv. *oryzicola* BLS256]
MQSALRAADDPSPTVRVAVTAARQPRAKPAPRRRAAQPSDASPAAQVDLRTLGYSQQQQEKIKPNVRSTV
AQHHEALVGHGFTHAHIVALSQHPAALGTVAVTYQHIITALPEATHEDIVGVGKQWSGARALEALLTKAG
ELRGPPLQLDTGQLLKIAKRGGVTAVEAVHASRNALTGAPLNLTPAQVVAIASNNGGKQALETVQRLLPV
LCQAHGLPPAQVVAIASHDGGKQALETVQRLLPVLCQAHGLTPAQVVAIASNIGGKQALETVQRLLPVLC
QDHGLTPDQVVAIASNIGGKQALETMQRLLPVLCQAHGLTPDQVVAIASNGGGKQALETVQRLLPVLCQD
HGLTPDQVVAIASNNGGKQALETVQRLLPVLCQAHGLTPDQVVAIASNNGGKQALETVQRLLPVLCQAHG
LSPDQVVAIASHDGGKQALETVQRLLPVLCQAHGLTPDQVVAIASNNGGKQALETVQRLLPVLCQAHGLT
LAQVVAIASNIGGKQALETVQRLLPVLCQTHGLTPAQVVAIASNIGGKQALETVQRLLPVLCQAHGLTPA
QVVAIANNNGGKQALETVQRLLPVLCQAHGLTPAQVVAIANNNGGKQALETVQRLLPVLCQAHGLTLDQV
VAIANNNGGKQALETVQRLLPVLCQAHGLTPDQVVAIASNGGGKQALETVQRLLPVLCQDHGLSPAQVVA
IASNIGSKQALETVQRLLPVLCQDHGLTPAQVVAIASHDGGKQALETVQRLLPVLCQDHGLTPDQVVAIA
SNGGGKQALESIVAQLSRPDPALAALTNDHLVALACLGGRPALDAVKKGLPHAPELIRRVNSRIGERTSH
RVADYAQVVRVLEFFQSHSQPAQAFDDAMAQFGMSRHGLVQLFRRVGVTELEASGGTLPPASQRWDRILQ
ASGMKRAKPSPTSAQTPDQASLHAFADSLERDPDAPSPMHEGDQTRASSRKRSRSDRAVTGPSAQQSFEV
RVPEQRDALHLPLSWSVKRPRTRIGGGLPDPGTPMAADLAASSTVMWEQDADPFAGAADDFPAFNEEELA
WLMELLPQ SEQ ID NO: 115
>gi|166711459|ref|ZP_02242666.1|avirulence protein AvrBs3/pth family [*Xanthomonas oryzae* pv. *oryzicola* BLS256]
MPAVGTPHTAAAPAEWDEVQSGLRAADDPPPTVRVAVTAARPPRAKPAPRRRAAQPSDASPAAQVDLRTL
GYSQQQQEKIKPKVRSTVAQHHEALVGHGFTHAHIVALSQHPAALGTVAVTYQHIITALPEATHEDIVGV
GKQWSGARALEALLTKAGELRGPPLQLDTGQLVKIAKRGGVTAVEAVHASRNALTGAPLNLTPDQVVAIA
SNIGGKQALETLQRLLPVLCQAHGLTPAQVVAIASNGGKQALETVQRLLPVLCQAHGLTPAQVVAIASNI
GGKQALETVQRLLPVLCQDHGLTPAQVVAIASNIGGKQALETVQRLLPVLCQAHGLTPAQVVAIASNNGG
KQALETVQRLLPVLCQDHGLSPDQVVAIASNGGKQALETVQRLLPVLCQAHGLTPDQVVAIASNIGGKQA
LETVQRLLPVLCQAHGLTPDQVVAIANNKGGKQALETVQRLLLVLCQAHGLTPDQVVAIASHDGGKQALE
TVQRLLPVLCQAHGLTPAQVVAIASHDGGKQALETVQRLLPVLCQAHGLTPAQVVAIASHDGGKQALETV
QRLLPVLCQAHGLTPAQVVAIASNGGGKQALETVQRLLPVLCQDHGLTLAQVVAIASNIGGKQALETVQR
LLPVLCQAHGLTPDQVVTIANNNGSKQALETVQRLLPVLCQAHGLTPAQVVAIASHDGGKQALETVQRLL
PVLCQAHGLTPDQVVAIANNNGGKQALETVQRLLPVLCQAHGLTPDQVVAIASHDGGKQALETVKRLLPV
LCQDHGLTPAQVVAIASNGGGKQALESIVAQLSRPDPALAALTNDHLVALACLGGRPALDAVKKGLPHAP
ELIRRVNSRIGERTSHRVADYAQVVRVLEFFQCHSHPAHAFDEAMTQFGMSRQGLVQLFRRVGVTELEAR
CGTLPPASQRWDRILQASGMKRAKPSPTSAQTPDQASLHAFADSLERDLDAPSPMHEGDQTRASSRKRSR
SDRAVTGPSAQQAVEVRVPEQRDALHLPLSWRVKRPRTRIGGGLPDPGTPMAADLAASSTVMWEQDAAPF
AGAADDFPAFNEEELAWLMELLPQ SEQ ID NO: 116
>gi|166711465|ref|ZP_02242672.1|avirulence protein AvrBs3/pth family [*Xanthomonas oryzae* pv. *oryzicola* BLS256]
MQSALRAADEPPPTVRVAVTAARPPRAKPAPRRRAAQPSDASPAAQVDLRTLGYSQQQQEKIKPNVRSTV
AQHHEALVGHGFTHAHIVALSQHPAALGTVAVKYQHIITALPEATHEDIVGVGKQWSGARALEALLTKAG
ELRGPPLQLDTGQLLKIARRGGVTAVEAVHAWRNALTGAPLNLTPAQVVAIASNNGGKQALETVQRLLPV
LCQAHGLTPDQVVAIASHDGGKQALETVQRLLPVLCQAHGLTPAQVVAIASNIGGKQALETVQRLLPVLC
QAHGLTPAQVVAIASHDGGKQALETVQRLLPVLCQDHGLTPDQVVAIASNNGGKQALETVQRLLPVLCQD
HGLTPAQVVAIASNGGGKQALETVQRLLPVLCQDHGLTPAQVVAIASNGGGKQALETVQRLLPVLCQAHG
LTPDQVVAIASHDGGKQALETVQRLLPVLCQAHGLTPDQVVAIASNNGGKQALETVQRLLPVLCQAHGLT
PAQVVAIASHDGGKQALETVQRLLPVLCQAHGLTPDQVVAIASNGGKQALETVQRLLPVLCQDHGLTLDQ
VVAIASNNGGKQALETVQRLLPVLCQARGLTPDQVVAIASHDGGKQALETVQRLLPVLCQDHGLIPAQVV
AIASHDGGKQALETVQRLLPVLCQDHGLTPDQVVAIASHDGGKQALETVQRLLPVLCQDHGLTPDQVVAI
ASNGGGKQALESIVAQLSRPDPALAALTNDHLVALACLGGRPALDAVKKGLPHAPELIRRVNSRIGERTS
HRVADYAQVVRVLEFFQSHSQPAQAFDDAMTQFGMSRHGLVQLFRRVGVTELEASGGTLPPASQRWHRIL
QASGMKRAKPSPTSAQTPDQASLHAFADSLERDPDAPSPMHEGDQTRASSRKRSRSDRAVTGPSAQQSFE
VRVPEQRDALHLPLSWSVKRPRTRIGGGLPDPGTPMAADLAASSTVMWEQDADPFAGAADDFPAFNEEEL
AWLMELLPQ SEQ ID NO: 117
>gi|166711722|ref|ZP_02242929.1|avirulence protein [*Xanthomonas oryzae* pv. *oryzicola* BLS256]
MPAVGTPHTAAAPAEWDEAQSGLRAADDPPPTVRVAVTAARPPRAKPAPRRRAAQPSDASPAAQVDLRTL
GYSQQQQEKIKPNVRSTVAQHHEALVGHGFTHAHIVALSQHPAALGTVAVTYQHIITALPEATHEDIVGV
GKQWSGARALEALLTDAGELRGPPLQLDTGQLVKIAKRGGVTAVEAVHAWRNALTGAPLNLTPDQVVAIA
SNSGGKQALEMVQRLLPVLCQDHGLTPDQVVAIASHGGGKQALETVQRLLPVLCQDHGLTPDQVVAIASN
IGGKQALETVQQLLPVLCQAHGLTPDQVVATASNGGGKQALETVQRLLPVLCQDHGLAPDQVVAVASNSG
GKQALETVQRLLPVLCQDHGLTPDQVVAIANNNGGKQALETVQRLLPVLCQDHGLTPDQVVAIASNDGGK
QALETVQRLLPVLCQDHGLSPDQVVAIASNGGKQALETVQRLLPVLCQDHGLTLDQVVAIASNGGGKQAL
ETVQRLLPVLCQDHGLTPDQVVAIASNGGKQALETVQRLLPVLCQDHGLTPAQVVAIASHNGGKQALKTV
QRLLPVLCQAHGLTPDQVVAIANNNGGKQALETVQRLLPVLCQDHGLTPDQVVAIASHDGGKQALETVQR
LLPVLCQAHGLTPDQVVAIASNSGGKQALETVQRLLPVLCQDHGLTPDQVVAIASNIGGKQALETVQRLL
PVLCQAHGLTPDQVVAIANNNGGKQALETVQRLLPVLCQAHGLTPAQVVAIASHDGGKQALETVQRLLPV
LCQDHGLTPAQVVAIASHDGGKQALETVQRLLPVLCQDHGLTPDQVVAIASNGGGKQALETVQRLLPVLC
QDHGLTPDQVVAIASNGGGKQALETVQRLLPVLCQDHGLTPDQVVAIASHGGGKQALETVQRLLPVLCQD TABLE 1-continued Endogenous TALE Polypeptide Sequences HGLTPDQVVAIASHDGGKQALETVQRLLPVLCQDHGLTPDQVVAIASNGGGKQALESIVAQLSRPDPALA
ALTNDHLVALACIGGRPALDAVKKGLPHAPNLIRRVNRRIPERTSHRVADYAQVVRVLEFFQCHSHPAHA
FDEAMTQFGMSRNGLLQLFRRVGVTEFEARYGTLPPASQRWDRILQASGMKRGKPSPTSAQTPDQASLHG
FADSLERDLDAPSPMQEGDQTRASSRKRSRSDRAVTGPSAQQAVEVRVPEQRDALHLPLSWRVKRPRTRI
GGGLPDPGTPMAADLAASSTVMWEQDADHFAGAADDFPAFNEEELAWLMELLPQ SEQ ID NO: 118
>gi|166711723|ref|ZP_02242930.1|avirulence protein [*Xanthomonas oryzae* pv. *oryzicola* BLS256]
MQSGLRAADDPPPTVRVAVTAARPPRAKPAPRRRAAQPSDASPAAQVDLRTLGYSQQQQEKIKPKVRSTV
AQHHEALVGHGFTHAHIVALSQHPAALGTVAVTYQHIITALPEATHEDIVGVGKQWSGARALEALLTKAG
ELRGPPLQLDTGQLLKIAKRGGVTAVEAVHASRNALTGAPLNLTPDQVVAIASNSGGKQALEMVQRLLPV
LCQDHGLTPDQVVAIASHGGGKQALETVQRLLPVLCQDHGLTPDQVVAIASNIGGKQALETVQRLLPVLC
QDHGLTPDQVVATASNGGGKQALETVQRLLPVLCQDHGLAPDQVVAVASNSGGKQALETVQRLLPVLCQD
HGLTPDQVVAIANNNGGKQALETVQRLLPVLCQDHGLTPDQVVAIASNGGGKQALETVQRLLPVLCQAHG
LTPAQVVAIASNNGGKQALETVQRLLPVLCQDHGLTLDQVVAIASNGGSKQALETVQRLLPVLCQAHGLT
LDQVVAIASHDGGKQALETVQRLLPVLCQDHGLTPDQVVAIANNNGGKQALETVQRLLPVLCQAHGLTRD
QVVAIASHDGGKQALETVQRLLPVLCQDHGLTRDQVVAIASHDGGKQALETVQRLLPVLCQDHGLTPDQV
VAIASNGGGKQALESIVAQLSRPDPALAALTNDHLVALACIGGRPALDAVKKGLPHAPEFIRRVNRRIAE
RTSHRVADYAHVVRVLEFFQCHSHPAHAFDEAMTQFGMSRNGLLQLFRRVGVTEFEARGGTLPPASQRWD
RILQASGMKRGKPSPTSAQTPDQASLHAFADSLERDLDAPSPMQEGDQTRASSRKQSRSDRAVTGPSAQQ
AVEVRVPEQRDALHLPLSWSVKRPRTRIGGGLPDPGTPMAADLAASSTVMWEQDAAPFAGAADDFPAFNE
EELAWLMELLPQ SEQ ID NO: 119
>gi|166711724|ref|ZP_02242931.1|avirulence protein [*Xanthomonas oryzae* pv. *oryzicola* BLS256]
MPAVGTPHTAAAPAEWDEAQSGLRAADDPPPTVRVAVTAARPPRAKPAPRRRAAQPSDASPAAQVDLRTL
GYSQQQQEKIKPKVRSTVAQHHEALVGHGFTHAHIVALSQHPAALGTVAVTYQHIIRALPGATHEDIVGV
GKQWSGARALEALLTDAGELRGPPLQLDTGQLLKIAKRGGVTAVEAVHASRNALTGAPLNLTPAQVVAIA
SNIGGKQALETVQRLLPVLCQDHGLTPDQVVAIASNGGGKQALETVQRLLPVLCQDHGLTPDQVVAIASN
IGGKQALETVQRLLPGLCQAHGLTPDQVVAIASNGGGKQALETVQRLLPVLCQDHGLTPDQVVAIASNNG
GKQALETVQQLLPVLCQDHGLTPDQVVAIASNGGGKQALETVQRLLPGLCQDHGLTPDQVVAIASNNGGK
QALETVQRLLPVLCQAHGLTPDQVVAIASNGGGKQALETVQRLLPVLCQAHGLTPDQVVAIASHDGGKQA
LETVQRLLPVLCQDHGLTPDQVVAIANNNGGKQALETVQRLLPVLCQDHGLTPDQVVAIANNNGGKQALE
TVQRLLPVLCQDHGLTPDQVVAIASHGGGKQALETVQRLLPVLCQAHGLTPAQVVAIASHDGGKQALETV
QRLLPVLCQDHGLTPDQVVAIASNNGGKQALETVQRLLPVLCQDHGLTPDQVVAIASNSGGKQALETVQR
LLPVLCQAHGLTPDQVVAIANNNGGKQALETVQRLLPVLCQDHGLTPDQVVAIASHDGSKQALETVQRLL
PVLCQDHGLTPDQVVAIASHDGSKQALETVQRLLPVLCQDHGLTPDQVVAIASNGGGKQALETVQRLLPV
LCQDHGLTLDQVVAIASNAGGKQALETVQRLLPVLCQDHGLTPAQVVAIANNNGGKQALETVQRLLPVLC
QDHGLTRDQVVAIASHDGGKQALETVQRLLPVLCQDHGLTPVQVVAIASHDGGKQALETVQRLLPVLCQA
HGLTRDQVVAIASHDGGKQALETVQRLLPVLCQDHGLTPVQVVAIASHDGGKQALETVQRLLPVLCQDHG
LTPAQVVAIASNGGKQALESIVAQLSRPDPALAALTNDHLVALACIGGRPALDAVKKGLPHAPELIRRIN
RRIPERTSHRVADLAHVVRVLEFFQCHSHPAHAFNEAMTQFGMSRNGLLQLFRRVGVTELEARGGTLPPA
SQRWDRILQASGMKRAKPSPTSAQTPDQASLHAFADSLERDLDAPSPMQEGDQTRASSRKQSRSDRAVTG
PSAQQAVEVRVPEQRDALHLPLSWRVKRPRTRIGGGLPDPGTPMAADLAASSTVMWEQDAAPFAGAADDF
PAFNEEELAWLMELLPQ SEQ ID NO: 120
>gi|166712159|ref|ZP_02243366.1|avirulence protein [*Xanthomonas oryzae* pv. *oryzicola* BLS256]
MPAVGTPHTAAAPAEWDEAQSGLRAADDPPPTVRVAVTAARPPRAKPAPRRRAAQPSDASPAAQVDLRTL
GYSQQQQEKIKPKVRSTVAQHHEALVGHGFTHAHIVALSQHPAALGTVAVTYQHIITALPEATHEDIVGV
GKQWSGARALEALLTDAGELRGPPLQLDTGQLLKIAKRGGVTAVEAVHASRNALTGAPLNLTPAQVVAIA
SNNGGKQALETVQRLLPVLCQTHGLTPAQVVAIASHDGGKQALETVQRLLPVLCQDHGLTPDQVVAIASN
SGGKQALETVQRLLPVLCQDHGLTPDQVVAIASNGGGKQALETVQRLLPVLCQDHGLTPDQVVAIASHDG
GKQALETVQRLLPVLCQDHGLTPNQLVAIANNNGGKQALETVQRLLPVLCQDHGLTPDQVVAIASHDGGK
QALETVQRLLPVLCQDHGLTPDQVVAIASNIGGKQALETVQRLLPVLCQDHGLTPAQVVAIASHDGGKQA
LETMQRLLPVLCQDHGLTPDQVVAIASNNGGKQALETMQRLLPVLCQDHGLTPAQVVAIVSHDGGKQALE
TVQRLLPVLCQTHGLTPDQVVAIASNNGGKQALETVQRLLPVLCQDHGLTPDQVVAIASHDGGKQALGTV
QRLLPVLCQAHGLTPDQVVAIASNNGGKQALETVQRLLPVLCQDHGLTPDQVVAIASHDGGKQALETVQR
LLPVLCQAHGLTPDQVVAIASNNGGKQALETVQRLLPVLCQAHGLTPDQVVAIANNNGGKQALETVQRLL
PVLCQTHGLTPAQVVAIASNNGSKQALETVQRLLPVLCQTHGLTPAQVVAIASNNGGKQALETVQRLLPV
LCQAHGLTPDQVVAIASNNGGKQALETVQRLLPVLCQAHGLTPAQVVAIASNNGGKQALETVQRLLPVLC
QAHGLTPDQVVAIASNNGGKQALETVQRLLPVLCQDHGLTPAQVVAIASHDGGKQALETVQRLLPVLCQD
HGLTPAQVVAIASNGGGKQALESIVAQLSRPDPALAALTNDHLVALACLGGRPALDAVKKGLPHAPELIR
RVNSRIGERTSHRVADYAQVVRVLEFFQCHSHPAHAFDEAMTQFGMSRNGLLQLFRRVGVTELEARGGTL
PPASQRWDRILQASGMKRAKPSCASAQTPDQASLHAFADSLERDLDAPSPMHEGDQTRASSRKRSRSDRA
VTGPSAQQAVEVRVPEQRDALHLPLSWSVKRPRTRIGGGLPDPGTPMAADLAASSTVMWEQDADPFAGAA
DDFPAFNEEELAWLMELLPQ SEQ ID NO: 121
>gi|166712165|ref|ZP_02243372.1|avirulence protein AvrBs3/pth family [*Xanthomonas oryzae* pv. *oryzicola* BLS256]
MPAVGTPHTAAAPAEWDEVQSGLRAAADPPPTVRVAVTAARPPRAKPAPRRRAAQPSDASPAAQVDLRTL
GYSQQQQEKIKPNVRSTVAQHHEALVGHGFTHAHIVALSKHPAALGTVAVTYQHIITVLPEATHEDIVGV
GKQWSGARALEALLTEAGELRGPPLQLDTGQLVKIAKRGGVTAVKAVHASRNALTGAPLNLTPAQVVAIA
SHHGGKQALETVQRLLPVLCQDHGLTLDQVVAIASNNGSKQALETVQRLLPVLCQDHGLTPDQVVAIASH TABLE 1-continued

| Endogenous TALE Polypeptide Sequences |
|---|
| DGGKQALETVQQLLPVLCQAHGLTPDQVMAIASHDGGKQALETVQRLLPVLCQAHGLTPDQVVAIASNGG GKQALETVQRLLPVLCQDHGLTPDQVVAIASNGGKQALETVQRLLPVLCQAHGLTPAQVVAIASHDGGKQ ALETVQRLLPVLCQAHGLTPDQVVAIANNNGGKQALETVQRLLPVLCQAHGLTPDQVVAIASHDGGKQAL ETVQRLLPVLCQAHGLTPYQVVAIASNDGSKQALETVQRLLPVLCQDHGLTPAQVVAIASNGGKQALETV QRLLPVLCQAHGLTLDQVVAIASNGGGKQALETVQRLLPVLCQAHGLTPAQVVAIASNSGGKQALETVQR LLPVLCQDHGLTPAQVVAIASNSGGKQALETVQRLLPVLCRDHGLTPDQVVAIANNNGGKQALETVQRLL PVLCQAHGLTPDQVVAIASHDGGKQALETVQRLLPVLCQDHGLTPAQVVAIASHDGGKQALETVQRLLPV LCQTHGLTPAQVVAIASNGGGKQALESIVAQLSRPDPALAALTNDHLVALACLGGRPALDAVKKGLPHAP EFIRRVNRRIPERTSHRVADYAHVVRVLEFFQCHSHPAHAFDEAMTQFGMSRHGLVQLFRRVGVTEFEAR YGTLPPASQRWDRILQASGMKRAKPSPTSAQTPDQAFLHAFADSLERDLDAPSPMHEGDQTRASSRKRSR SDRAVTGPSAQQAVEVRVPEQRDALHLPLSWSVKRPRTRIWGGLPDPGTPMAADLAASSTVMWEQDVDHF AGAADDFPAFNEEELAWLMELLPQ |
| SEQ ID NO: 122<br>>gi\|166712533\|ref\|ZP_02243740.1\|avirulence protein AvrBs3/pth family [*Xanthomonas oryzae* pv. *oryzicola* BLS256]<br>MPAVGTPHTAAAPAEWDEVQSALRAADDPPPTVRVAVTAARQPRAKPAPRRRAAQPSDASPAAQVDLRTL GYSQQQQEKIKPKVRSTVAQHHEALVGHGFTHAHIVALSQHPAALGTVAVTYQHIITALPEATHEDIVGV GKQWSGARALEALLADAGELRGPPLQLDTGQLVKIAKRGGVTAVEAVHASRNALTGAPLNLTPAQVVAIA SNNGGKQALETVQWLLPVLCQAHGLSPDQVVAIASHDGGKQALETVQRLLPVLCQAHGLTPAQVVAIASN IGGKQALETVQRLLPVLCQDHGLPPDQVVAIASNIGGKQALETVQRLLPVLCQAHGLTPAQVVAIASNNG GKQALETVQRLLPVLCQAHGLTPAQVVAIASHAGGKQALETVQRLLPVLCQAHGLTPAQVVAIASNNGGK QALETVQRLLPVLCQAHGLTPAQVVAIASNSGGKQALETVQRLLPVLCQAHGLTPAQVVAIASNSGGKQA LETVQRLLPVLCQAHGLTPAQVVAIASNIGGKQALETVQRLLPVLCQAHGLTPAQVVAIASHDGGKQALE TVQRLLPVLCQDHGLTPDQVVAIASHAGGKQALETVQRLLPVLCQAHGLTPAQVVAIASHAGGKQALETV QRLLPVLCQAHGLTPAQVVAIASHAGSKQALETVQRLFPVLCQAHGLTPAQVVAIASHDGGKQALETVQR LLPVLCQAHGLIPAQVVAIASHDGGKQALETVQRLLPVLCQAHGLTPAQVVAIASHDGGKQALETVQRLL PVLCQDHGLIPAQVVAIASHAGGKQALETVQRLLPVLCQDHGLTPAQVVAIASHDGGKQALETVQRLLPV LCQDHGLTPDQVVAIASNGGKQALESIVAQLSRPDPALTALTNDHLVALACLGGRPALDAVKKGLPHAPN LIRRVNSRIGERTSHRVADYAQVVRVLEFFQCHSHPAHAFDEAMTQFGMSRHGLVQLFRRVGVTEFEARY GTLPPASQRWDRILQASGMKRAKPSPTSAQTPDQASLHAFADSLERDLDAPSPMHEGDQTRASSRKRSRS DRAVTGPSAQQAVEVRVPEQRDALHLPLSWRVKRPRTRIGGGLPDPGTPMAADLAASSTVMWEQDADPFA GAADDFPAFNEEELAWLRELLPQ |
| SEQ ID NO: 123<br>>gi\|166712572\|ref\|ZP_02243779.1\|avirulence protein AvrBs3/pth family [*Xanthomonas oryzae* pv. *oryzicola* BLS256]<br>MPAVGTPHNTAAAPAEWDEAQSGLRAADDPPPTVRVAVTAARPPRAKPAPRRRAAQSSDASPAAQVDLRT LGYSQQQQEKIEPNVRSTVAQHHEALVGHGFTHAHIVALSRHPAALGTVAVTYQHIITALPEATHEDIVG VGKQWSGARALEALLTKAGELRGPPLQLDTGQLVKIARRGGVTAVEAVHASRNALTGAPLNLTPAQVVAI ASNNGGKQALETVQRLLPVLCQAHGLTPDQVVAIASHDGGKQALETVQRLLPVLCQAHGLTPDQVVAIAS HDGGKQALETVQRLLPVLCQAHGLTPDQVVAIASHHGGKQALETVQRLLPVLCQDHGLTPAQVVAIASNN GGKQALETVQRLLPVLCQAHGLTPDQVVAIASNGGGKQALETVQRLLPVLCQDHGLTPAQVVAIASNSGG KQALETVQRLLPVLCQAHGLTPDQVVAIASNGGGKQALETVQRLLPVLCQAHGLTPDQVVVIASHDGGKQ ALETVQRLLPVLCQAHGLTPDQVVAIASNIGGKQALETVQRLLPVLCQAHGLTLDQVVAIASNGGSKQAL ETVQRLLPVLCQDHGLTPDQVVAIASHDGGKQALETVQRLLPVLCQDHGLTPDQVVAIASHHGSKQALET MQRLLPVLCQDHGLTPDQVVTIASNGGGKQALETVQRLLPVLCQDHGLTPDQVVAIASNGGGKQALETVQ RLLPVLCQDHGLTLDQVVAIASNGGGKQALETVQRLLPVLCQEHGLSQDQVVAIASHAGGKQALETVQRL LPVLCQDHGLTPAQVVAIASNGGGKQALESIVAQLSRPDPALAALTNDHLVALACLGGRPALDAVKKGLP HAPELIRRVNSRIGERTSHRVADYAHVVRVLEFFQCHSHPAHAFDEAMTQFGMSRHGLVQLFRRVGVTEF EARCGTLPPASQRWDRILQASGMKRAKPSPTSAQTPDQASLHGFADSLERDLDAPSPMHEGDQTRASSRK RSRSDHAVTGPSAQQAVEVRVPEQRDALHLPLSWSVKRPRTRIGGGLPDPGTPMAADLAASSTVMWEQDA APFAGAADDFPAFNEEELAWLMELLPQ |
| SEQ ID NO: 124<br>>gi\|166713629\|ref\|ZP_02244836.1\|avirulence protein AvrBs3/pth family [*Xanthomonas oryzae* pv. *oryzicola* BLS256]<br>MQSALRAADDPPPTVRVAVTAARPPRAKPAPRRRAAQPSDALPAAQVDLRTLGYSQQQQEKIKPKVRSTV AQHHEALVGHGFTHAHIVALSQHPAALGTVAVTYQHIITALPEATHEDIVGVGKQWSGARALEALLTDAG ELRGPPLQLDTGQLLKIAKRGGVTAVEAVHASRNALTGAPLNLTPAQVVAIASNNGGKQALETVQRLLPV LCQDHGLTPDQVVAIASNGGGKQALETVQRLLPVLCQDHDLTPDQVVAIASHDGGKQALETVQRLLPVLC QDHGLTPDQVVAIASNGGGKQALETVQRLLPVLCQDHGLTPDQVVAIASHDGGKQALETVQRLLPVLCQD HGLTPDQVVAIASHDGGKQALETVQRLLPVLCQDHGLTPDQVVAVAGNIGGKQALETVQRLLPVLCQDHG LTPDQVVAIANNHGGKQALETVQRLLPVLCQDHGLTPDQVVAIASHGGGKQALETVQRLLPVLCQAHGLT PDQVVAIASNIGGKQALETVQRLLPVLCQAHGLTPDQVVAIANNNGGKQALETVQRLLPVLCQEHGLTLD QVVSIASNNGGKQALETVQRLLPVLCQDHGLTPDQVVAIASHDGGKQALETVQRLLPVLCQDHGLTPDQV VAIANNSGGKQALETVQRLLPVLCQDHGLTLAQVVAIASNGGGKQALETVQRLLPVLCQDHGLTPAQVVA IANNNGGKQALETVQRLLPVLCQAHGLTPAQVVAIASHDGGKQALETVQRLLPVLCQDHGLTPDQVVAIA SNGGGKQALETVQRLLPVLCQDHGLTPDQVVAIASNGGGKQALETVQRLLPVLCQDHGLTPDQVVAIASN GGKQALESIVAQLSRPYPALTALTNDHLVALACLGGRPALDAVKKGLPHAPELIRRINRRIPERTSHRVA DYAQVVRVLEFFQCHSHPAQAFDDAMTQFGMSRQGLVQLFRRVGVTEFEARYGTLPPASQRWDRILQASG MKRAKPSCASAQTPDQASLHGFADSLERDLDAPSPMHEGEQTRASSRKRSRSDRAVTGPSAQQAVEVRVP EQRDALHLPLSWSVKRPRTRIGGGLPDPGTPMAADLAASSTVMWEQDADHFAGAADDFPAFNEEELAWLM ELLPQ |

TABLE 1-continued

Endogenous TALE Polypeptide Sequences

SEQ ID NO: 125
>gi|166713848|ref|ZP_02245055.1|avirulence protein AvrBs3/pth family
[*Xanthomonas oryzae* pv. *oryzicola* BLS256]
MPAVGTPHTAAAPAEWDEAQSGLRAADDPPPTVRVAVTAARPPRAKPAPRRRAAQPSDASPAAQVDLRTL
GYSQQQQEKIKPKVRSTVAQHHEALVGHGFTHAHIVALSQHPAALGTVAVTYQHIITALPEATHEDIVGV
GKQWSGARALEALLTDAGELRGPPLQLDTGQLVKIAKRGGVTAVEAVHASRNALTGAPLNLTPAQVVAIA
SNIGGKQALETVQRLLPVLCQDHGLTPDQVVAIANNNGGKQALETVQRLLPVLCQAHGLTPDQVVAIASH
NGGKQALETVQRLLPVLCQDHGLTPDQVVAIASNNGGKQALETVQRLLPVLCQAHGLIPDQVVAIASNIG
GKQALETVQRLLPVLCLTPAQVVAIASNGGGKQALETVQRLLPVLCQDHGLTPDQVVAIASHDGGKQALE
TVQRLLPVLCQDHGLTPDQVVAIASNNGGKQALETVQRLLPVLCQAHGLTPAQVVAIASHDGGKQALETV
QRLLPVLCQAHGLTPAQVVAIASHGGGKQALETVQRLLPVLCQAHGLTPAQVVAIASHDGGKQALETVQR
LLPVLCQAHGLTPDQVVAIASHGGGKQALETVQRLLPVLCQAHGLTPDQVVAIASHGGGKQALETVQRLL
PVLCQDHGLTPAQVVAIASHDGGKQALETVQRLLPVLCQDHGLTPAQVVAIASHDGGKQALETVQRLLPV
LCQDHGLTPDQVVAIASNGGGKQALESIVAQLSRPDPALAALTNDHLVALACLGGRPALDAVKKGLPHAP
ELIRRVNSRIGERTSHRVADYAQVVRVLEFFQCHSHPAHAFDEAMTQFGMSRQGLLQLFRRVGVTELEAR
GGTLPPASQRWHRILQASGMKRAEPSPTSAQTPDQASLHAFADSLERDLDAPSPMHEGDQTRASSRKRSR
SDRAVTGPSAQQAVEVRVPEQRDALHLPLSWSVKRPRTRIGGGLPDPGTPMAADLAASSTVMWEQDADPF
AGAADDFPAFNEEELAWLMELLPQ SEQ ID NO: 126
>gi|166713849|ref|ZP_02245056.1|avirulence protein AvrBs3/pth family
[*Xanthomonas oryzae* pv. *oryzicola* BLS256]
MQSALRAADDPPPTVRVAVTAARPPRAKPAPRRRAAQPSDASPAAQVDLRTLGYSQQQQEKIKPNVRSTV
AQHHEALVGHGFTHAHIVALSQHPAALGTVAVTYQHIITALPEATHEDIVGVGKQWSGARALEALLTDAG
ELRGPPLQFDTGQLLKIAKRGGVTAVEAVHASRNALTGAPLNLTPAQVVAIASNNGGKQALETVQRLLPV
LCQAHGLTPDQVVAIASNSGGKQALETVQRLLPMLCQDHGLTPDQVVAIASNGGGKQALETVQRLLPVLC
QDHGLTPDQVVAIASNIGSKQALETVQRLLPVLCQAHGLTPDQVVATASHDGGKQALETVQRLLPVLCQD
HGLTPDQVVAIASHDGGKQALETVQRLLPVLCQDHGLTPDQVVAIASNGGGKQALETVQRLLPVLCQAHG
LTPTQVVAIASNNGGKQALETVQRLLPVLCQDHGLTPDQVVAIASHDGGKQALETVQRLLPVLCQAHGLT
LAQVVAIASNIGGKQALETVQRLLPVLCQDHGLTPDQVVAIASNGGGKQALETVQRLLPALCQDHGLTPD
QVVAIASNGGKQALETVKRLLPVLCQAHGLTPDQVVAIASNGGKQALETVQRLLPVLCQDHGLTPDQVVA
IASNGGGKQALETVQRLLPVLCQDHGLTPDQVVAIASHDGGKQALETVQRLLPVLCQAHGLTPDQVVAIA
SHDGGKQALETVQRLLPVLCQAHGLTPAQVVAIASNSGGKQALETVQRLLPVLCQAHGLTPDQVVAIASN
IGGKQALETVQRLLPVLCQDHGLTPAQVVAIASNNGGKQALETVQRLLPVLCQDHGLTLDQVVAIASNGG
SKQALETVQRLLPVLCQTHGLTPAQVVAIASNGGGKQALESIVAQLSRPDPALAALTNDHLVALACLGGR
PALDAVKKGLPHAPEFIRRVNSRIAERTSHRVADYAQVVRVLEFFQCHSHPAQAFDDAMTQFGMSRHGLV
QLFRRVGVTEFEARYGTLPPASQRWDRILQASGMKRAKPSPTSAQTPDQTSLHAFADSLERDLDAPSPMH
EGDQTRASSRKRSRSDRAVTGPSAQQAVEVRVPEQRDALHLPLSWRVKRPRTRIGGGLPDPGTPIAADLA
ASSTVMWEQDVDHFAGAADDFPAFNEEELAWLRELLPQ SEQ ID NO: 127
>gi|166713970|ref|ZP_02245177.1|avirulence protein AvrBs3/pth family
[*Xanthomonas oryzae* pv. *oryzicola* BLS256]
MQSALRAADDPPPTVRVAVTAARPPRAKPAPRRRAAQPSDASPAAQVDLRTLGYSQQQQEKIKPNMRSTV
AQHHEALVGHGFTHAHIVALSQHPAALGTVAVTYQHIITALPEATHEDIVGVGKQWSGARALEALLTKAG
ELRGPPLQLDTGQLLKIAKRGGVTAVEAVHAWRNALTGAPLNLTPAQVVAIASHDGGKQALETVQRLLPV
LCQAHGLTPDQVVAIASHGGGKQALETVQRLLPVLCQAHGLTPAQVVAIASHDGGKQALETVQRLLPVLC
QAHGLTPDQVVAIASHGGGKQALETVQRLLPVLCQAHGLTPDQVVAIASNGGKQALETVQRLLPVLCQDH
GLTPDQVVAIANNNGGKQALETLQRLLPVLCQDHGLTPDQVVAIASNGGGKQALETVQRLLPVLCQAHGL
TPDQVVAIASHDGGKQALETVQRLLPVLCQDHGLTPDQVVAIANNNGGKQAVETVQRLLPVLCQAHGLTP
NQVVAIASHDGGKQALETVQRLLPVLCQDHGLTPDQVVAIASNGGGKQALETVQRLLPVLCQAHGLTLTQ
VVAIASNGGGKQALETVQRLLPVLCQAHGLTPDQVVAIANNNGGKQALETVQRLLPVLCQAHGLTPDQVV
AIASHDGGKQALETVQRLLPVLCQAHGLTPAQVVAIASNGGKQALETVRRLLPVLCQAHGLTPDQVVAIA
SNGGGKQALETVQRLLPVLCQDHGLTPDQVVAIASNGGGKQALESIVAQLSRRDPALAALTNDHLVALAC
LGGRPALDAVKKGLPHAPEFIRRVNRRIAERTSHRVADYAHVVRVLEFFQCHSHPAQAFDDAMTQFGMSR
HGLVQLFRRVGVTEFEARYGTLPPASQRWDRILQASGMKRAKPSPTSAQTPDQTSLHAFADSLERDLDAP
SPMHEGDQTRASSRKRSRSDRAVTGPSAQQAVEVRVPEQRDALHLPLSWRVKRPRTRIGGGLPDPGTPIA
ADLAASSTVMWEQDVDHFAGAADDFPAFNEEELAWLRELLPQ SEQ ID NO: 128
>gi|166713979|ref|ZP_02245186.1|avirulence protein AvrBs3/pth family
[*Xanthomonas oryzae* pv. *oryzicola* BLS256]
MPAVGTPHTAAAPAEWDEVQSALRAADDPPPTVRVAVTAARPPRAKPAPRRRAAQPSDASPAAQVDLRTL
GYSQQQQEKIKPKVRSTVAQHHEALVGHGFTHAHIVALSQHPAALGTVAVTYQHIITALPEATHEDIVGV
GKQWSGARALEALLTDAGELRGPPLQLDTGQLVKIAKRGGVTAMEAVHASRNALTGAPLNLTPAQVVAIA
SHDGGKQALETVQRLLPVLCQDHGLPPDQVVAIASHDGGKQALETVQRLLPVLCQDHGLPPDQVVAIASH
DGGKQALETVQRLLPVLCQDHGLTPDQVVAIASHDGGKQALETVQRLLPVLCQDHGLTPDQVVAIASHDG
GKQALETVQRLLPVLCQDHGLTPDQVVAIASNGGGKQALETLQRLLPVLCQAHGLTPAQVVAIASHDGGK
QALETVQRLLPMLCQAHGLTPDQVMAIASNNGGKQALETVQRLLPVLCQDHGLTPDQVVAIASHDGGKQA
LETVQRLLPVLCQDHGLTLAQVVAIASNDGGKQALETVQRLLPVLCQAHGLTPAQVVAIASNGGGKQALE
TVQRLLPVLCQAHGLTLDQVVAIASNGGGKQALETVQRLLPVLCQAHGLTPAQVVAIASNNGGKQALETV
QRLLPVLCQDHGLTPAQVVAIASHGGGKQALETVQRLLPVLCQDHGLTPDQVVAIASNDGGKQALETVQR
LLPVLCQDHGLTPDQVVAIASNDGGKQALETVQRLLPVLCQDHGLTPDQVVAIASHDGGKQALETVQRLL
PVLCQTHGLTPAQVVAIASNGGGKQALESIVAQLSRPDPALAALTNDHLVALACLGGRPALDAVKKGLPH
APEFIRRVNSRIAERTSHRVADYAQVVRVLEFFQCHSHPAHAFDEAMTQFGMSRHGLVQLFRRVGVTEFE TABLE 1-continued Endogenous TALE Polypeptide Sequences ARYGTLPPASQRWDRILQASGMKRAKPSPTSAQTPDQASLHAFADSLERDLDAPSPMQEGDQTRASSRKR
SRSDRAVTGPSAQQAVEVRVPEQRDALHLPLSWRVKRPRTRIWGGLPDPGTPMAADLAASSTLMWEQDVD
HFAGAADDFPAFNEEELAWLRELLPQ SEQ ID NO: 129
>gi|166713984|ref|ZP_02245191.1|avirulence protein AvrBs3/pth family
[*Xanthomonas oryzae* pv. *oryzicola* BLS256]
MQSALRAADDPPPTVRVAVTAARPPRAKPAPRRRAAQPSDASPAAQVDLRTLGYSQQQQEKIKPKVRSTV
AQHHEALVGHGFTHAHIVALSQHPAALGTVAVTYQHIITALPEATHEDIVGVGKQWSGARALEALLTKAG
ELRGPPLQLDTGQLVKIAKRGGVTAVEAVHAWRNALTGAPLNLTPDQVVAIASHDGGKQALETVQRLLPV
LCQAHGLTPDQVVAIASNNGSKQALETVQRLLPVLCQDHGLTPAQVVAIASHDGGKQALETVQRLLPVLC
QAHGLPPDQVVAIASNGGKQALETVQRLLPVLCQDHGLTPDQVVAIASNSGGKQALETVQRLLPVLCQDH
GLTPDQVVAIASNNGGKQALETVQRLLPVLCQAHGLTPDQVVAIASHGGGKQALETVQRLLPVLCQDHGL
TPDQVVAIASNIGGKQALETVQRLLPVLCQAHGLTPAQVVAIASNIGGKQALETVQRLLPVLCQAHGLTP
DQVVAIASNSGGKQALETVQRLLPVLCQDHGLTPDQVVAIASNIGGKQALETVQRLLPVLCQAHGLTLDQ
VVAIASNGGSKQALETVQRLLPVLCQAHGLTPAQVVAIASHDGGKQALETVQRLLPVLCQAHGLTPAQVV
AIASNNGGKQALETVQRLLPVLCQAHGLTPDQVVAIASHDGGKQALETVQRLLPVLCQAHGLTPDQVVAI
ASHDGGKQALETVQRLLPVLCQAHGLTPAQVVAIASNGGGKQALETVQRLLPVLCQDHGLTPDQVVAIAS
HGGGKQALETVQRLLPVLCQDHGLTPDQVVAIASNGGGKQALESIVAQLSRPDPALAALTNDHLVALACL
GGRPALDAVKKGLPHAPEFIRRVNRRIGERTSHRVADYAHVVRVLEFFQCHSHPAHAFDEAMTQFGMSRN
GLLQLFRRVGVTELEARCGTLPPASQRWDRILQASGMKRAKPSPTSAQTPDQASLHAFADSLERDLDAPS
PMHEGDQTRASSRKRSRSDRAVTGPSAQQAVEVRVPEQRDALHLPLSWSVKRPRTRIGGGLPDPGTPMAA
DLAASSTVMWEQDAAPFAGAADDFPAFNEEELAWLMELLPQ SEQ ID NO: 130
>gi|166714107|ref|ZP_02245314.1|hypothetical 125K protein [*Xanthomonas
oryzae* pv. *oryzicola* BLS256]
MQSALRAADDPPPTVCVAVTAARPPRAKPAPRRRAAQPSDASPAAQVDLRTLGYSQQQREKIKPNVRSTV
AQHHEALVGHGFTHAHIVALSQHPAALGTVPVTYQHIITALPEATHEDIVGVGKQWSGARALEALLTDAG
ELRGPPLQLDTGQLLKIAKRGGVTAVEAVHASRNALTGAPLNLTPDQVVAIASNSGGKQALEMVQRLLPV
LCQAHGLTPAQVVAIASHDGGKQALETVQRLLPVLCQAHGLTPDQVVAIASNIGGKQALETVQRLLPVLC
QAHGLTPDQVVAIASNGGKQALETVQRLLPVLCQAHGLTPDQVVAIASNIGGKQALETVQRLLPVLCQDH
GLTPDQVVAIASHGGGKQALETVQRLLPVLCQDHGLTPDQVVAIASNIGGKQALETVQRLLPVLCQDHGL
TLAQVVAIASNIGGKQALETVQRLLPVLCQAHGLTPDQVVAIASNGGKQALETVQRLLPVLCQAHGLTPD
QVVAIASNGGGKQALETVQRLLPVLCQDHGLTPDQVVAIASHDGGKQALETVQRLLPVLCQDHGLTPDQV
VAIANNNGGKQALETLQRLLPVLCQAHGLTPAQVVAIASNIGGKQALETVQRLLPVLCQAHGLTPDQVVA
IASNGGSKQALETVQRLLPVLCQDHGLTPDQVVAIASHDGGKQALETVQRLLPVLCQDHGLTPAQVVAIA
NNNGGKQALETVQRLLPVLCQDHGLSPAQVVAIASNSGGKQALETVQRLLPVLCHDHGLTPAQVVAIANN
NGGKQALETVQRLLPVLCQDHGLTPAQVVAIASNGGGKQALETVQRLLPVLCQDHGLTPDQVVAIASNNG
GKQALESIVAQLSRPDPALAALTNDHLVALACLGGRPALDAVKKGLPHAPELIRRVNSRIGERTSHRVAD
YAQVVRVLEFFQCHSHPAHAFDEAMTQFGMSRNGLLQLFRRVGVTELEARGGTLPPASQRWHRILQASGM
KRAEPSPTSAQTPDQASLHAFADSLERDLDAPSPMHEGDQTRASSRKRSRSDRAVTGPSAQQAVEVRVPE
QRDALHLPLSWRVKRPRTRIGGGLPDPGTPMAADLAASSTVMWEQDAAPFAGAADDFPAFNEEELAWLRE
LLPQ
SEQ ID NO: 131
>gi|187472109|gb|ACD11364.1|Avr/pthC8b [*Xanthomonas oryzae* pv. *oryzae*]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAECDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVTY
QDIIRALPEATHEDIVGVGKQWSGARALEALLTEAGELRGPPLQLDTGQLLKIAKRGGVTAVEAVHAWRN
ALTGAPLNLTPDQVVAIASNIGGNQALETVQRLLPVLCQAHGLTPDQVVAIASHGGGKQALETVQRLLPV
LCQDHGLTPDQVVAIASNIGGKQALETVQRLLPVLCQDHGLTPDQVVAIASNIGGKQALETVQRLLPVLC
QDHGLTPDQVVAIASNIGGKQALETVQRLLPVLCQDHGLTPDQVVAIANNNGGKQALETVQRLLPVLCQD
HGLTPDQVVAIASHDGGKQALETVQRLLPVLCQGHGLTPDKVVAIASNSGGKQALETVQRLLPVLCQAHG
LTPDKVVAIANNNGGKQGKQALETVQRLLPVLCQDHGLTPDQVVAIASNSGGKQALETVQRLLPVLCQDH
GLTPAQVVAIANNNGGKQALETVRRLLPVLCQDHGLTPDQVVAIASHDGGKQALETVQRLLPVLCQDHGL
TPDQVVAIANNNGGKQALETVQRLLPVLCQNHGLTPDQVVAIASNIGGKQALETVQRLLPVLCQDHGLTP
DQVVAIASHDGGKQALETVQRLLPVLCQDHGLTPAQVVAIANNNGGKQALETVRRLLPVLCQDHGLSPDQ
VVAIASNSGGKQALETVQRLLPVLCQDHGLTPAQVVAIASNGGGKQALESIVAQLSRPDPALAALTNDHL
VALACLGGRPALDAVKKGLPHAPELIRRINRRIPERTSHRVADYAQVVRVLEFFQCHSHPAYAFDEAMTQ
FGMSRNGLLQLFRRVGVTELEARGGTLPPASQRWDRILQASGMKRAKPSPTSAQTPDQASLHAFADSLER
DLDAPSPMHEGDQTGASSRKRSRSDRAVTGPSAQQSFEVRVPEQHDALHLPLSWRVKRPRTRIGGGLHDP
GTPIAADLAASSTVMWEQDAAPFAGAADDFPAFNEEELAWLMELLPQSGSVGGTI SEQ ID NO: 132
>gi|188574801|ref|YP_001911730.1|TAL effector AvrBs3/PthA [*Xanthomonas
oryzae* pv. *oryzae* PXO99A]
MTAVEAVHAWRNALTGAPLNLTPDQVVAIASNIGGKQALETVQRLLPVLCQDHGLTPDQVVAIARNGGGK
QALETVQRLLPVLCQDHGLTPDQVVAIASNIGGKQALETVQRLLPVLCQDHGLTPDQVVAIASNIGGKQA
LATVQRLLPVLCQAHGLTPDQVVAIASNGGKQALETVQRLLPVLCQDHGLTPDQVVAIASNNGGKQALET
VQRLLPVLCQDHGLTPDQVVAIASHDGGKQALETVQRLLPVLCQDHGLTPDQVVAIASHDGGKQALETVQ
RLLPVLCQDHGLTPDQVVAIASNGGKQALETVQRLLPVLCQDHGLTLAQVVAIASNIGGKQALETVQRLL
PVLCQDHGLTPDQVVAIASNIGGKQALETVQRLLPVLCQDHGLTPDQVVAIASNIGGKQALETVQRLLPV
LCQAHGLTPDQVVAIASNGGGKQALETVQRLLPVLCQDHGLTPDQVVAIASHDGGKQALETVQRLLPVLC
QDHGLTPDQVVAIASHGGGKQALETVQRLLPVLCQDHGLTPDQVVAIANNNGGKQALETVQRLLPVLCQD
HGLTPAQVVAIASNSGGKQALETVQRLLPVLCQDHGLTPDQVVAIANNNGGKQALEMVQRLLPVLCQDHG
LTPDQVVAIASHDGGKQALETVQRLLPVLCQDHGLTLDQVVAIASHDGGKQALETVQRLLPVLCQDHGLT
PDQVVAIASNGGGKQALETVQRLLPVLCQDHGLTPAQVVAIASNGGKQALESIVAQLSRPDPALAALTND TABLE 1-continued

| Endogenous TALE Polypeptide Sequences |
| --- |

HLVALACLGGRPALDAVKKGLPHAPELIRRINRRIPERTSHRVPDLAHVVRVLGFFQSHSHPAQAFDDAM
TQFEMSRHGLVQLFRRVGVTEFEARYGTLPPASQRWDRILQASGMKRAKPSPTSAQTPDQASLHAFADSL
ERDLDAPSPMHEGDQTGASSRKRSRSDRAVTGPSAQQSFEVRVPEQRDALHLPLSWRVKRPRTRIGGGLP
DPGTPIAADLAASSTVMWEQDAAPFAGAADDFPAFNEEELAWLMELLPQSGSVGGTI

SEQ ID NO: 133
>gi|188575846|ref|YP_001912775.1|TAL effector AvrBs3/PthA [*Xanthomonas oryzae* pv. *oryzae* PXO99A]
MQSGLRAADDPPPTVRVAVTAARPPRAKPAPRRRAAQPSDASPAAQVDLRTLGYSQQQQEKIKPKVGSTV
AQHHEALVGHGFTHAHIVALSRHPAALGTVAVKYQDMIAALPEATHEDIVGVGKQWSGARALEALLTVAG
ELRGPPLQLDTGQLVKIAKRGGVTAVEAVHASRNALTGAPLNLTPAQVVAIASNNGGKQALETVQRLLPV
LCQAHGLTPAQVVAIASHDGGKQALETMQRLLPVLCQAHGLPPDQVVAIASNIGGKQALETVQRLLPVLC
QAHGLTPDQVVAIASHGGGKQALETVQRLLPVLCQAHGLTPDQVVAIASHDGGKQALETVQRLLPVLCQA
HGLTPDQVVAIASNGGGKQALETVQRLLPVLCQAHGLTPDQVVAIASNGGKQALETVQRLLPVLCQAHGL
TPDQVVAIASHDGGKQALETVQRLLPVLCQTHGLTPAQVVAIASHDGGKQALETVQQLLPVLCQAHGLTP
DQVVAIASNIGGKQALATVQRLLPVLCQAHGLTPDQVVAIASNGGGKQALETVQRLLPVLCQAHGLTPDQ
VVAIASNGGGKQALETVQRLLPVLCQAHGLTQVQVVAIASNIGGKQALETVQRLLPVLCQAHGLTPAQVV
AIASHDGGKQALETVQRLLPVLCQAHGLTPDQVVAIASNGGGKQALETVQRLLPVLCQAHGLTQEQVVAI
ASNNGGKQALETVQRLLPVLCQAHGLTPDQVVAIASNGGGKQALETVQRLLPVLCQAHGLTPAQVVAIAS
NIGGKQALETVQRLLPVLCQDHGLTLAQVVAIASNIGGKQALETVQRLLPVLCQAHGLTQDQVVAIASNI
GGKQALETVQRLLPVLCQDHGLTPDQVVAIASNIGGKQALETVQRLLPVLCQDHGLTLDQVVAIASNGGK
QALETVQRLLPVLCQDHGLTPDQVVAIASNSGGKQALETVQRLLPVLCQDHGLTPNQVVAIASNGGKQAL
ESIVAQLSRPDPALAALTNDHLVALACLGGRPAMDAVKKGLPHAPELIRRVNRRIGERTSHRVADYAQVV
RVLEFFQCHSHPAYAFDEAMTQFGMSRNGLVQLFRRVGVTELEARGGTLPPASQRWDRILQASGMKRAKP
SPTSAQTPDQASLHAFADSLERDLDAPSPMHEGDQTGASSRKRSRSDRAVTGPSAQHSFEVRVPEQRDAL
HLPLSWRVKRPRTRIGGGLPDPGTPIAADLAASSTVMWEQDAAPFAGAADDFPAFNEEELAWLMELLPQS
GSVGGTI SEQ ID NO: 134
>gi|188575849|ref|YP_001912778.1|TAL effector AvrBs3/PthA [*Xanthomonas oryzae* pv. *oryzae* PXO99A]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAECDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVTY
QDIITALPEATHEDIVGVGKQWSGARALEALLTEARELRGPPLQLDTGQLLKIAKRGGVTAVEAVHAWRN
ALTGAPLNLTPDQVVAIASNIGGKQALETVQRLLPVLCQDHGLTPDQVVAIASNGGGKQALETVQRLLPV
LCQAHGLTPDQVVAIASNNGGKQALETVQRLLPVLCQDHGLTPDQVVAIASNGGGKQALETVQRLLPVLC
QDHGLTPDQVVAIANNKGGKQALETLQRLLPVLCQAHGLTPDQVVAIASNGGGKQALETVQRLLPVLCQD
HGLTPAQVVAIASNIGGKQALETVQRLLPVLCQDHGLTPDQVVAIANNNGGKQALETVQRLLPVLCQDHG
LTPDQVVTIASNIGGKQALEMVQRLLPVLCQDHGLTPDQVVAIANNNGGKQALETVQRLLPVLCQAHGLT
PDQVVAIASNIGGKQTLETVQRLLPVLCQDHGLTPDQVVAIASHDGGKQALETVQRLLPVLCQDHGLTLD
QVVAIASNGGKQALETVQRLLPVLCQDHGLTPDQVVAIASNSGGKQALETVQRLLPVLCQDHGLTPNQVV
AIASNGGKQALESIVAQLSRPDPALAALTNDHLVALACLGGRPALDAVKKGLPHAPELIRRINRRIPERT
SHRVPDLAHVVRVLGFFQSHSHPAQAFDDAMTQFGMSRHGLVQLFRRVGVTEFEARYGTLPPASQRWDRI
LQASGMKRAKPSPTSAQTPDQASLHAFADSLERDLDAPSPMHEGDQTRASSRKRSRSDRAVTDPSTQQSF
EVRVPEQRDALHLPLSWRVKRPRTRIGGGLPDPGTPIAADLAASSTVLWEQDAAPFAGAADDFPAFNEEE
LAWLMELLPQSGSVGGTI SEQ ID NO: 135
>gi|188576052|ref|YP_001912981.1|TAL effector AvrBs3/PthA [*Xanthomonas oryzae* pv. *oryzae* PXO99A]
MQRLLPVLCQAHGLTPDQVVAIASHDGGKQALETVQRLLPVLCQAHGLTPAQVVAIASHDGGKQALETVQ
RLLPVLCQAHGLTLDQVVAIASNGGGKQALETVQRLLPVLCQAHGLTPDQVVAIASHDGGKQALETVQRL
LPVLCQDHGLTPAQVVAIASNNGGKQALETVQRLLPVLCQAHGLTLDQVVAIASNGGGKQALETVQRLLP
VLCQAHGLTPDQVVAIASHDGGKQALETVQRLLPVLCQDHGLTPAQVVAIASNNGGKQALETVQRLLPVL
CQAHGLTPDQVVAIASHDGGKQALETVQRLLPVLCQAHGLTPDQVVAIASNGGGKQALETVQRLLPVLCQ
AHGLTPDQVVAIASHDGGKQALETVQRLLPVLCQDHGLTPDQVVAIASNIGGKQALETVQRLLPVLCQDH
GLTPDQVVAIASNGGKQALESIVAQLSRPDPALAALTNDHLVALACLGGRPALDAVKKGLPHAPELIRRV
NSRIGERTSHRVADLAHVVRVLGFFQSHSHPAQAFDDAMTQFGMSRHGLVQLFRRVGVTEFEARCGTIPP
ASQRWDRILQASGTKRAKPSPTSAQTPDQASLHAFPDSLERDLDAPSPMHEGDQTRASRRKRS SEQ ID NO: 136
>gi|188576058|ref|YP_001912987.1|TAL effector AvrBs3/PthA [*Xanthomonas oryzae* pv. *oryzae* PXO99A]
MTAVEAVHAWRNALTGAPLNLTPDQVVAIASNSGGKQALETVQRLLPVLCQDHGLTPDQVVAIASHDGGK
QALETVQRLLPVLCQDHGLTPDQVVAIASNGGGKQALETVQRLLPVLCQDHGLTPDQVVAIASNGGGKQA
LETVLCQAHGLTPAQVVAIASNGGGKQALETVQRLLPVLCQAHGLTLDQVVAIASNGGGKQALETVQRLL
PVLCQAHGLTPAQVVAIASNGGGKQALETVQRLLPVLCQAHGLTPAQVVAIASHDGGKQALETVQRLLPV
LCQAHGLTLDQVVAIASHDGGKQALETVQRLLPVLCQAHGLTLDQVVAIASHDGGKQALETVQRLLPVLC
QDHGLTPAQVVAIASNNGGKQALETVQRLLPVLCQDHGLTPDQVVAIASHDGGKQALETMQRLLPVLCQA
HGLTPDQVVAIASNGGGKQALETVQRLLPVLCQAHGLTPDQVVAIASHDGGKQALETVQRLLPVLCQDHG
LTPDQVVAIASHDGGKQALETVQRLLQVLCQDHGLTPDQVVAIASHDGGKQALETVQRLLPVLCQDHGLT
PDQVVAIASHDGGKQALETVQRLLPVLCQDHGLTPDQVVAIASNGGKQALESIVAQLSRRDPALAALTND
QLVALACLGGRPAPHSRKRKSHD TABLE 1-continued

| Endogenous TALE Polypeptide Sequences |
|---|

SEQ ID NO: 137
>gi|188576253|ref|YP_001913182.1|TAL effector AvrBs3/PthA [*Xanthomonas oryzae* pv. *oryzae* PXO99A]
MVAIASNIGGKQALETVQRLLPVLCQAHGLTPDQVVAIANNNGGKQALETVQRLLPVLCQAHGLTPAQVV
AIASNNGGKQALETVQRLLPVLCQDHGLTPDQVVAIASNIGGKQALETVQRLLPVLCQDHGLTPDQVVAI
ASNIGGKQALETVQRLLPVLCQTHALTPDQVVAIASNIGGKQALETVQRLLPVLCQDHGLTPAQVVAIAS
HDGGKQALETVQRLLPVLCQDHGLTPDQVVAIASNSGGKQALETVQRLLPVLCQAHGLTLDQVVAIASHG
GGKQALETVQRLLPVLCQDHGLTPDQVVAIASNNGGKQALETVQRLLPVLCQDHGLIPDQVVAIANNNGG
KQALETVQRLLPVLCQAHGLTTDQVVTIASNNGGKQALETVQRLLPVLCQDHGLTPDQVVAIASNIGGKQ
ALETVQRLLPVLCQDHGLTLDQVVAIASNIGGKQALETVQRLLPVLCQDHGLTPDQVVAIASHGGGKQAL
ETVQRLLPVLCQDHGLTPDQVVAIASHDGGKQALESIVAQLSRPDPALAALTNDHLVALACLGGRPALDA
VKKGLPHAPELIRRINRRIPERTSHRVADYAQVVRVLEFFQCHSHPAYAFDEAMTQFGMSRNGLVQLFRR
VGVTELEARGGTLPPASQRWDRILQASGMKRAKPSPTSAQTPDQASLHAFADSLERDLDAPSPMHEGDQT
GASSRKRSRSDRAVTGPSAQQSFEVRVPEQHDALHLPLSWRVKRPRTRIGGGLPDPGTPIAADLAASSTV
MWEQDAAPFAGAADDFPAFNEEELAWLMELLPQSGSVGGTI SEQ ID NO: 138
>gi|188576523|ref|YP_001913452.1|TAL effector AvrBs3/PthA [*Xanthomonas oryzae* pv. *oryzae* PXO99A]
MVAIASNIGGNQALETVQRLLPVLCQDHGLTPDQVVAIASHGGKQALETVQRLLPVLCQDHGLTPDQVVA
IASNIGGKQALETVQRLLPVLCQDHGLTPAQVVAIASNNGGKQALETVQRLLPVLCQAHGLTPDQVVAIA
SNNGGKQALETVQRLLPVLCQAHGLTPDQVVAIANNNGGKQALETVQRLLPVLCQDHGLSPDQVVAIANN
NGGKQALETLQRLLPVLCQTHALTPDQVVAIANNNGGKQALETVQRLLPVLCQDHGLTPDQVVAIASHDG
GKQALETVQRLLPVLCQDHGLTPDQVVAIASNIGGKQALETVQRLLPVLCQDHGLTPDQVVAIASHDGGK
QALETVQRLLPVLCQDHGLTPAQVVAIASHGGGKQALETVQRLLPVLCQAHGLTPDQVVAIASHDGGKQA
LETVQRLLPVLCQAHGLTPNQVVAIASNIGGKQALETVQRLLPVLCQDHGLTPDQVVAIASNGGKQALET
VQRLLPVLCQAHGLTPDQVVAIASNSGGKQALETVQRLLPVLCQDHGLTPNQVVAIASNIGGKQALETVQ
RLLPVLCQDHGLTPDQVVAIASNIGGKQALETVQRLLPVLCQDHGLTLDQVVAIASHGGGKQALETVQRL
LPVLCQDHGLTSDQVVAIASHDGGKQALETVQRLLPVLCQDHGLTPDQVVAIASNSGGKQALETVQRLLP
VLCQDHGLTPAQVVAIASNSGGKQALETVQRLLPVLCQAHGLTPNQVVAIASNGGGKQALESIVAQLSRP
DPALAALTNDHLVALACLGGRPALDAVKKGLPHAPNLIRRVNSRIGERTSHRVADLAQVVRVLEFFQCHS
HPAHAFDEAMTQFGMSRNGLLQLFRRVGVTELEARGGTLPPASQRWDRILQASGMKRAKPSPTSAQTPDQ
ASLHAFADSLERDLDALSPMHEGDQTRASSRKRSRSDRAVTGPSAQQSFEVRVPEQHDALHLPLSWRVKR
PRTRIGGGLPDPGTPIAADLAASSTVMWEQDAAPFAGAADDFPAFNEEELAWLMELLPQSGSVGGTI SEQ ID NO: 139
>gi|188576528|ref|YP_001913457.1|TAL effector AvrBs3/PthA [*Xanthomonas oryzae* pv. *oryzae* PXO99A]
MVAIASNIGGKQALETVQRLLPVLCQAHGLTPDQVVAIASNSGGKQALETVQRLLPVLCQDHGLTPDQVV
AIASHDGGKQALETVQRLLPVLCQAHGLTPDQVVAIASHGGGKQALETVQRLLPVLCQAHGLTPDQVVAI
ASNSGGKQALETVQRLLPVLCQAHGLTPDQVVAIANNNGGKQALETVQRLLPVLCQDHGLSPDQVVAIAS
HDGGKQALETVQRLLPVLCQDHGLTPDQVVAIASHGGKQALETVQRLLPVLCQDHGLTPDQVVAIASNGG
GKQALETVQRLLPVLCQDHGLTPDQVVAIANNNGGKQALATVQRLLPVLCQAHGLTPDQVVAIANNNGGK
QALATVQRLLPVLCQAHGLTPDQVVAIASHDGGKQALETVQRLLPVLCQAHGLTPDQVVAIASHDGGKQA
LETVQRLLPVLCQAHGLTPDQVVAIASNGGGKQALETVQRLLPVLCQAHGLTPDQVVAIASHDGGKQALE
TVQRLLPVLCQDHGLTPDQVVAIASNGGGKQALESIVAQLSRPDPALAALTNDHLVALACLGGRPALDAV
KKGLPHAPELIRRINRRIPERTSHRVADLAHVVRVLGFFQSHSHPAQAFDDAMTQFGMSRHGLVQLFRRV
GVTEFEARYGTLPPASQRWDRILQASGMKRAKPSPTSAQTPDQASLHAFADSLERDLDAPSPMHEGDQTR
ASSRKRSRSDRAVTGPSTQQSFEVRVPEQHDALHLPLSWRVKRPRTRIGGGLPDPGTPIAADLAASSTVM
WEQDAAPFAGAADDFPAFNEEELAWLMELLPQSGSVGGTI SEQ ID NO: 140
>gi|188576551|ref|YP_001913480.1|TAL effector AvrBs3/PthA [*Xanthomonas oryzae* pv. *oryzae* PXO99A]
MTAVEAVHAWRNALTGAPLNLTPDQVVAIASNIGGNQALETVQRLLPVLCQAHGLTPDQVVAIASNGGKQ
ALETVQRLLPVLCQDHSLTPDQVVAIASNIGGKQALETVQRLLPVLCQDHGLTPDQVVAIASNSGGKQAL
ETVQRLLPVLCQDHGLTPDQVMTIASNNGGKQALETVQRLLPVLCQDHGLTPDQVVTIASNGGGKQALET
VQRLLPVLCQDHGLTPAQVVAIANNNGGKQALETVQRLLPVLCQAHGLTPAQVVAIASNSGGKQALETVQ
RLLPVLCQAHGLTPDQVVAIASNGGKQALETVQRLLPVLCQAHGLTPDQVVAIASNSGGKQALETVQRLL
PVLCQAHGLTPDQVVAIANNNGGKQALETVQRLLPVLCQDHGLTPDQVVAIASNSGGKQALETVQRLLPV
LCQDHGLTPDQVVAIASNGGKQALETVQRLLPVLCQDHGLTPDQVVAIASNIGGKQALETVQRLLPVLCQ
DHGLTPDQVVAIASHGGGKQALETVQRLLPVLCQDHGLTSDQVVAIASHDGGKQALETVQRLLPVLCQDH
GLTPDQVVAIASNIGGKQALETVQRLLPVLCQDHGLTLDQVVAIASHDGGKQALETVQRLLPVLCQDHGM
TPDQVVAIASHDGGKQALETVQRLLPVLCQDHGLTPDQVVAIASNGGGKQALESIVAQLSRPDPALAALT
NDHLVALACLGGRPALDAVKKGLPHAPELIRRINRRIPERTSHRVADLAHVVRVLGFFQSHSHPAQAFDD
AMTQFGMSRHGLVQLFRRVGVTELEARCGTLPPASQRWDRILQASGMKRAKPSPTSAQTPDQASLHAFAD
SLERDLDAPSPMHEGDQTRASSRKRSRSDRAVTGPSTQQSFEVRVPEQHDALHLPLSWRVKRPRTRIGGG
LPDPGTPIAADLAASSTVMWEQDAAPFAGAADDFPAFNEEELAWLMELLPQSGSVGGTI SEQ ID NO: 141
>gi|188576555|ref|YP_001913484.1|TAL effector AvrBs3/PthA [*Xanthomonas oryzae* pv. *oryzae* PXO99A]
MTAVEAVHAWRNALTGAPLNLTPDQVVAIASNIGGKQALETVQRLLPVLCQDHGLTPDQVVAIASHGGGK
QALETVQRLLPVLCQAHGLTPDQVVAIASNIGGKQALETVQRLLPVLCQDHGLTPDQVVAIASHGGGKQA
LETVQRLLPVLCQDHGLTPDQVVAIASNIGGKQALETVQRLLPVLCQDHGLIPDQVVAIASNIGGKQALE
TVQRLLPVLCQDHGLTPDQVVAIASNIGGKQALETVQRLLPVLCQAHGLTPDQVVAIASHDGGKQALETV
QRLLPVLCQDHGLTPAQVVAIASNNGGKQALETVQRLLPVLCQAHGLTPDQVVAIASHDGGKQALETVQR TABLE 1-continued Endogenous TALE Polypeptide Sequences LLPVLCQDHGLTPAQVVAIASNSGGKQALETVQRLLPVLCQDHGLTPDQVVAIASNGGGKQALETVQRLL
PVLCQDHGLTPDQVVAIASSSGGKQALETVQRLLPVLCQDHGLTPDQVVAIASHDGGKQALETVQRLLPV
LCQDHGLTPDQVVAIASNIGGKQALETVQRLLPVLCQAHGLTPDQVVAIASNIGGKQALETVQRLLPVLC
QDHGLTPDQVVAIANNNGGKQALETVQRLLPVLCQDHGLTPDQVVAIASNIGGKQALETVQRLLPVLCQD
HGLTPAQVVAIANNNGGKQALETVQRLLPVLCQDHGLTPDQVVAIASNIGGKQALETVQRLLPVLCQDHG
LTPDQVVAIASNGGGKQALESIVAQLSRPDPALAALTNDHLVALACLGGRPALDAVKKGLPHAPELIKRI
NRRIPERTSHRVADLPERTSHRVADLAHVVRVLGFFQSHSHPAQAFDDAMTQFGMSRHGLVQLFRRVGVT
EFEARCGTLPPASQRWDRILQASGMKRAKPSPTSAQTPDQASLHAFADSLERDLDAPSPMHEGDQTRASS
RKRSRSDRAVTGPSTQQSFEVRVPEQHDALHLPLSWRVKRPRTRIGGGLPDPGTPIAADLAASSTVMWEQ
DAAPFAGAADDFPAFNEEELAWLMELLPQSGSVGGTI SEQ ID NO: 142
>gi|188576826|ref|YP_001913755.1|TAL effector AvrBs3/PthA [*Xanthomonas oryzae* pv. *oryzae* PXO99A]
MTAVEAVHAWRNALTGAPLNLTPDQVVAIASNIGGNQALETVQRLLPVLCQAHGLTPDQVVAIASHGGGK
QALETVQRLLPVLCQDHGLTPDQVVAIASNIGGKQALETVQRLLPVLCQDHGLTPDQVVAIASNIGGKQA
LETVQRLLPVLCQDHGLTPDQVVAIASNIGGKQALETVQRLLPVLCQDHGLTPDQVVAIANNNGGKQALE
TVQRLLPVLCQDHGLTPDQVVAIASHDGGKQALETVQRLLPVLCQGHGLTPDKVVAIASNSGGKQALETV
QRLLPVLCQAHGLTPDKVVAIANNNGGKQALETVQRLLPVLCQDHGLTPDQVVAIASNSGGKQALETVQR
LLPVLCQDHGLTPAQVVAIANNNGGKQALETVRRLLPVLCQDHGLTPDQVVAIASHDGGKQALETVQRLL
PVLCQDHGLTPDQVVAIANNNGGKQALETVQRLLPVLCQNHGLTPDQVVAIASNIGGKQALETVQRLLPV
LCQDHGLTPDQVVAIASHDGGKQALETVQRLLPVLCQDHGLTPAQVVAIANNNGGKQALETVRRLLPVLC
QDHGLSPDQVVAIASNSGGKQALETVQRLLPVLCQDHGLTPDQVVAIASNGGGKQALESIVAQLSRPDPA
LAALTNDHLVALACLGGRPALDAVKKGLPHAPELIRRINRRIPERTSHRVADYAQVVRVLEFFQCHSHPA
YAFDEAMTQFGMSRNGLLQLFRRVGVTELEARGGTLPPASQRWDRILQASGMKRAKPSPTSAQTPDQASL
HAFADSLERDLDAPSPMHEGDQTGASSRKRSRSDRAVTGPSAQHSFEVRVPEQHDALHLPLSWRVKRPRT
RIGGGLPDPGTPIAADLAASSTVLWEQDAAPFAGAADDFPAFNEEELAWLMELLPQSGSVGGTI SEQ ID NO: 143
>gi|188576830|ref|YP_001913759.1|TAL effector AvrBs3/PthA [*Xanthomonas oryzae* pv. *oryzae* PXO99A]
MTAVEAVHAWRNALTGAPLNLTPDQVVAIASNIGGNQALETVQRLLPVLCQAHGLTPDQVVAIASHGGGK
QALETVQRLLPVLCQDHGLTPDQVVAIASNSGGKQALETVQRLLPVLCQDHGLTPDQVVAIASHGGGKQA
LETLQRLLPVLCQDHGLTPDQVVAIASHGGGKQALETLQRLLPVLCQAHGLTPAQVVALASHDGGKQALE
TVQRLLPVLCQDHGLTPDQVVAIASNSGGKQALETVQRLLPVLCQDHGLTPDQVVAIASNGGGKQALETV
QRLLPVLCQDHGLTPDHVVAIASHDGGKQALETVQRLLPVLCQDHGLTPDQVVAIANNNGGKQALETVQR
LLPVLCQAHGLTPDQVVAIASNGGGKQALETVQRLLPVLCQDHGLTPAQVVAIASHGGGKQALETVQRLL
PVLCQAHGLTPDQVVAIASNGGGKQALETVQRLLPVLCQDHGLTPDQVVAIASHDGGKQALETVQRLLPV
LCQDHGLTPDQVVAIASHGGGKQALETVQRLLPVLCQDHGLTPDQVVAIASHDGGKQALETVQRLLPVLC
QDHGLTPDQVVAIASHDGGKQALETVQRLLPVLCQDHGLTLDQVVAIASNIGGKQALETVQRLLPVLCQD
HGLTPAQVVAIANNNGGKQALETVQRLLPVLCQDHGLTPDQVVAIASNGGGKQALESIVAQLSCPDPALA
ALTNDHLVALACLGGRPALDAVKKGLPHAPELIRRINRRIPERTSHRVADLPERTSNRVADLAQVVRVLG
FFQSHSHPAQAFDDAMTQFGMSRHGLVQLFRRVGVTELEARCGTLPPASQRWDRILQASGMKRAKPSPTS
AQTPDQASLHAFADSLERDLDAPSPMHEGDQTRASSRKRSRLDRAVTGPSTQQSFEVRVPEQRDALHLPL
SWRVKRPRTRIGGGLPDPGTPIAADLAASSTVMWEQDAAPFAGAADDFPAFNEEELAWLMELLPQSGSVG
GTI SEQ ID NO: 144
>gi|188578160|ref|YP_001915089.1|TAL effector AvrBs3/PthA [*Xanthomonas oryzae* pv. *oryzae* PXO99A]
MDLRTLGYSQQQQEKIKPKVRSTVAQHHEALVGHGFTHAHIVALSQHPAALGTVAVTYQDIIRALPEATH
EDIVGVGKQWSGARALEALLTEAGELRGPPLQLDTGQLLKIAKRGGVTAVKAVHAWRNALTGAPLNLTPA
QVVAIASHDGGNQALETVQRLLPVLCQDHGLTPAQVVAIASHDGGKQALETVQRLLPVLCQDHGLTPDQV
VAIASHDGGKQALETVQRLLPVLCQDHGLTPAQAVAIASNGGGKQALETVQRLLPVLCQDHGLTPDQVVA
IASNGGKQALETVQRLLPVLCQDHGLTPDQVVAIASNNGGKQALETVQRLLPVLCQDHGLTPDQVVAIAS
HDGGKQALETVQRLLPVLCQDHGLTPDQVVAIASHDGGKQALETVQRLLPVLCQDHGLTPDQVVAIASNG
GKQALETVQRLLPVLCQDHGLTLAQVVAIASNIGGKQALETVQRLLPVLCQDHGLTPDQVVAIASNIGGK
QALETVQRLLPVLCQDHGLTPDQVVAIASNNGGKQALETVQRLLPVLCQDHGLTPDQVVAIASHDGGKQA
LETVQRLLPVLCQDHGLTPAQVVAIASHIGGKQALETVQRLLPVLCQDHGLTLDQVVAIASNDGSKQALE
TVQRLLPVLCQDHGLTPDQVVAIASHDGGKQALETVQRLLPVLCQDHGLTPNQVVAIASNIGGKQALETV
QRLLPVLCQAHGLTPDQVVAIASHDGGKQALETVQRLLPVLCQNHGLTPDQVVAIASNGGGKQALETVQR
LLPVLCQDHGLTPDQVVAIASNGGGKQALESIVAQLSRPDPALAALTNDHLVALACLGGRPALDAVKKGL
PHAPELIRRINRRIPERTSHRVADLAHVVRVLGFFQSHSHPAQAFDDAMTQFGMSRHGLVQLFRRVGVTE
LEARCGTLPPASQRWDRILQASGMKRAKPSPTSAQTPDQASLHAFADSLERDLDAPSPMHEGDQTRASNR
KRSRSDRAVTGPSTQQSFEVRVPEQRDALHLPLSWRVKRPRTRIGGGLPDPGTPIAADLAASSTVMWEQD
AAPFAGAADDFPAFNEEELAWLMELLPQSGSVGGTI SEQ ID NO: 145
>gi|188578164|ref|YP_001915093.1|TAL effector AvrBs3/PthA [*Xanthomonas oryzae* pv. *oryzae* PXO99A]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEVQSGLRAADDPPPTVRVAVTAARPPRAKPAPRRR
AAQPSDASPAAQVDLRTLGYSQQQQEKIKPKVRSTVAQHHEALVGHGFTHAHIVALSQHPAALGTVAVTY
QDIITALPEATHEDIVGVGKQWSGARALEALLTKAGELRGPPLQLDTGQLLKIAKRGGVTAVEAVHASRN
ALTGAPLNLTPDQVVAIASHDGGKQALETVQRLLPVLCQAHGLTPAQVVAIASHDGGKQALETVQRLLPV
LCQAHGLTPAQVVAIASNNGGKQALETVQRLLPVLCQAHGLTPDQVVAIASNNGGKQALETVQRLLPVLC
QAHGLTPDQVVAIASNGGGKQALETVQRLLPVLCQAHGLTPDQVVAIASNGGGKQALETVQRLLPVLCQA
HGLPPAQVVAIASHDGGKQALETVQRLLPVLCEAHGLTPAQVVAIASNSGGKQALETVQRLLPVLCQAHG TABLE 1-continued Endogenous TALE Polypeptide Sequences LTLDQVVAIASHGGSKQALETVQRLLPVLCQDHGLTPDQVVAIASHDGGKQALETVQRLLPVLCQAHGLT
PAQAVAIASNGGGKQALETVQRLLPVLCQDHGLTPDQVVAIASNGGKQALETVQRLLPVLCQDHGLTPDQ
VVAIASHDGGKQALATVQRLLPVLCQDHGLTPDQVVAIASHDGGKQALETVQRLLPVLCQDHGLTPDQVV
AIASHDGGKQALETVQRLLPVLCQDHGLTPDQVVAIASNGGKQALETVQRLLPVLCQDHGLTPDQVVAIA
NNNGGKQALETVQRLLPVLCQDHGLTPDQVVAIASNQVVAIASNIGGKQALETVQRLLPVLCQDHGLTPD
QVVAIASNNGGKQALETVQRLLPVLCQDHGLTPDQVVAIASHDGGKQALETVQRLLPVLCQDHGLTPAQV
VAIASHIGGKQALETVQRLLPVLCQDHGLTLDQVVAIASNDGSKQALETVQRLLPVLCQDHGLTPDQVVA
IASHDGGKQALETVQRLLPVLCQDHGLTPDQVVAIASHGGGKQALETVQRLLPVLCQDHGLTSAQVVAIA
NNNGGKQALETVQRLLPVLCQDHGLTPDQVVAIASHGGGKQALETVQRLLPVLCQDHGLTPDQVVAIASN
GGKQALESIVAQLSRPDPALAALTNDHLVALACLGGRPALDAVKKGLPHAPELIRRINRRIPERTSHHVP
DLAHVVRVLGFFQSHSHPAQAFDDAMTQFGMSRNGLVQLFRRVGVTELEARGGTLPPASQRWDRILQASG
MKRAKPSPTSAQTPDQASLHAFADSLERDLDAPSPMHEGDQTGASSRKRSRSDRAVTGPSAQQSFEVRVP
EQRDALHLPLSWRVKRPRTRIGGGLPDPGTPIAADLAASSTVLWEQDAAPFAGAADDFPAFNEEELAWLM
ELLPQSGSVGGTI SEQ ID NO: 146
>gi|188578168|ref|YP_001915097.1|TAL effector AvrBs3/PthA [*Xanthomonas oryzae* pv. *oryzae* PXO99A]
MTAVEAVHASRNALTGAPLNLTPDQVVAIASNIGGNQALETVQRLLPVLCQDHGLTPDQVVAIANNNGGK
QALETVQRLLPVLCQAHGLTPDQVVAIASNGGKQALETVQRLLPVLCQAHGLTPNQVVAIASNGGGKQAL
ETVQRLLPVLCQAHGLTQDQVVAIASNSGGKQALETVQRLLPVLCQAHGLTPAQVVAIASNNGGKQALET
VQRLFPVLCQDHGLTPDQVVTIANNNGGKQALETVQRLLPVLCQAHGLIPDQVVAIANNNGGKQALETVQ
RLLPVLCQAHGLTPAQVVAIASNIGGKQALETVQRLLPVLCRAHGLTPAQVVAIANNNGGKQALETVQRL
LPVLCQAHGLTPDQVVAIASNIGGKQALETVQRLLPVLCQDHGLTPDQVVAIASNGGKQALETVQRLLPV
LCQDHGLTPAQVVAIASHDGGKQALETVQRLLPVLCQDHGLTLDQVVAIASHDGGKQALETVQRLLPVLC
QDHGLTLDQVVAIASNIGGKQALETVQRLLPVLCQDHGLTPDQVVAIASNGGGKQALETVQRLLPVLCQD
HGLTPDQVVAIASNGGGKQALESIVAQLSRPDPALAALTNDHLVALACLGGRPALDAVKKGLPHAPELIR
RINRRIPERTSHRVADLAHVVRVLGFFQSHSHPAQAFDDAMTQFGMSRHGLVQLFRRVGVTEFEARCGTL
PPASQRWDRILQASGMKRAKPSPTSAQTPDQASLHAFADSLERDLDAPSPMHEGDQTRASSRKRSRSDRA
VTGPSTQQSFEVRVPEQRDALHLPLSWRVKRPRTRIGGGLPDPGTPIAADLAASSTVMWEQDAAPFAGAA
DDFPAFNEEELAWLMELLPQSGSVGGTI SEQ ID NO: 147
>gi|188578172|ref|YP_001915101.1|TAL effector AvrBs3/PthA [*Xanthomonas oryzae* pv. *oryzae* PXO99A]
MTAVEAVHAWRNALTGAPLNLTPDQVVAIASNIGGKQALETVQRLLPVLCQDHGLTPDQVVAIASNNGGK
QALETVQRLLPVLCQAHGLTPDQVVAIASNIGGKQALETVQRLLPVLCQDHGLTPDQVVAIASHGGGKQA
LETVQRLLPVLCQDHGLTPDQVVAIASHGGGKQALETVQRLLPVLCQDHGLTPDQVVAIANNVGGKQALA
TVQRLLPVLCQDHGLTPDQVVAIASHGGGKQALETVQRLLPVLCQDHGLTPDQVVAIASHDGGKQALETV
QRLLPVLCQDHGLTPDQVVAIASHGGGKQALETVQRLLPVLCQDHGLTPDQVVAIASHDGGKQALETVQR
LLPVLCQDHGLTLDQVVAIASHDGGKKALETVQRLLPVLCQDHGLTPDQVVAIASHDGGKQALETVQRLL
PVLCQDHGLTPDQVVAIASNGGGKQALESIVAQLSRPDPALAALTNDHLVALACLGGRPALDAVKKGLPH
APELIRRVNSRIGERTSHRVADYAQVVRVLEFFQCHSHPAYAFDEAMTQFGMSRHGLVQLFRRVGVTEFE
ARCGTLPPASQRWDRILQASGMKRAKPSPTSAQTPDQASLHAFADSLERDLDAPSPMHEGDQTRASSRKR
SRSDRAVTGPSAQQSFEVRVPEQRDALHLPLSWRVKRPRTRIGGGLPDPGTPIAADLAASSTVMWEQDAA
PFAGAADDFPAFNEEELAWLMELLPQSGSVGGTI SEQ ID NO: 148
>gi|188578176|ref|YP_001915105.1|TAL effector AvrBs3/PthA [*Xanthomonas oryzae* pv. *oryzae* PXO99A]
MTAVEAVHASRNALTGAPLNLTPAQVVAIASNNGGKQALETVQRLLPVLCQAHGLTPAQVVAIASHDGGK
QALETVQRLLPVLCQDHGLTPDQVVAIASNSGGKQALETVQRLLPVLCQDHGLTPDQVVAIASNGGGKQA
LETVQRLLPVLCQDHGLTPDQVVAIASHDGGKQALETVQRLLPVLCQDHGLTPDQLVAIANNNGGKQALE
TVQRLLPVLCQDHGLTPDQVVAIASNGGKQALETVQRLLPVLCQDHGLTPDQVVAIASNIGGKQALETVQ
RLLPVLCQAHGLTPAQVVAIASHDGGKQALETMQRLLPVLCRAHGLTPAQVVAIASNSGGKQALETVQRL
LPVLCQAHGLTPAQVVAIVSHDGGKQALETVQRLLPVLCQAHGLTPDQVVAIASNNGGKQALETVQRLLP
VLCQDHGLTPDQVVAIASHDGGKQALGTVQRLLPVLCQDHGLTPDQVVAIASNNGGKQALETVQRLLPVL
CQDHGLTPDQVVAIASHDGGKQALETVQRLLPVLCQAHGLTPAQVVAIASNNGGKQALETVQRLLPVLCQ
DHGLTPDQVVAIANNNGGKQALETVQRLLPVLCQAHGLTPAQVVAIASNNGSKQALETVQRLLPVLCQAH
GLTPAQVVAIASNNGGKQALETVQRLLPVLCQAHGLTPDQVVAIASNNGGKQALETVQRLLPVLCQAHGL
TPDQVVAIASNNGGKQALETVQRLLPVLCQAHGLTPDQVVAIASNNGGKQALETVQRLLPVLCQDHGLTP
AQVVAIASHDGGKQALETVQRLLPVLCQDHGLTPAQVVAIASNGGGKQALESIVAQLSRPDPALAALTND
HLVALACLGGRPALDAVKKGLPHAPELIRRVNSRIGERTSHRVADYAQVVRVLEFFQCHSHPAYAFDEAM
TQFGMSRNGLLQLFRRVGVTELEARGGTLPPASQRWDRILQASGMKRAKPSCASAQTPDQASLHAFADSL
ERDLDAPSPMHEGDQTRASSRKRSRSDRAVTGPSAQQSFEVRVPEQRDALHLPLSWRVKRPRTRIGGGLP
DPGTPMAADLAASSTVMWEQDAAPFAGAADDFPAFNEEELAWLMELLPQSGSVGGTI SEQ ID NO: 149
>gi|190410568|ref|YP_001965982.1|AvrBs3-like protein [*Xanthomonas axonopodis* pv. *glycines*]
MDPIRSRTPSPARELLPGPQPDGVQPTADRGVSPPAGGPLDGLPARRTMSRTRLPSPPAPSPAFSAGSFS
DLLRQFDPSLFNTSLFDSLPPFGAHHTEAATGEWDEVQSGLRAADAPPPTMRVAVTAARPPRAKPAPRRR
AAQPSDASPAAQVDLRTLGYSQQQQEKIKPKVRSTVAQHHEALVGHGFTHAHIVALSQHPAALGTVAVKY
QDMIAALPEATHEAIVGVGKQWSGARALEALLTVAGELRGPPLQLDTGQLLKIAKRGGVTAVEAVHAWRN
ALTGAPLNLTPEQVVAIARNIGGKQALETVQRLLPVLCQAHGLTPEQVVAIASNSGGKQALETVQRLLPV
LCQAHGLTPEQVVAIASHDGGKQALETVQRLLPVLCQAHGLTPAQVVAIASNGGGKQALETVQRLLPVLC
QAHGLTPEQVVAIASHDGGKQALETVQRLLPVLCQAHGLTPAQVVAIASNGGGKQALETVQRLLPVLCQA
HGLTPAQVVAIASNGGGKQALETVQRLLPVLCQAHGLTPAQVVAIASHDGGKQALETVQRLLPVLCQAHG TABLE 1-continued Endogenous TALE Polypeptide Sequences LTPEQVVAIASNIGGKQALETVQRLLPVLCQAHGLTPQQVVAIASNGGGRPALETVQRLLPVLCQAHGLT
PEQVVAIASNIGGKQALETVQRLLPVLCQAHGLTPQQVVAIASNGGGRPALETVQRLLPVLCQAHGLTPE
QVVAIASNIGGKQALETVQRLLPVLCQAHGLTPQQVVAIASNGGGRPALETVQRLLPVLCQAHGLTPEQV
VAIASNIGGKQALETVQRLLPVLCQAHGLTPQQVVAIASHDGGKQALETVQRLLPVLCQAHGLTPEQVVA
IASNIGGKQALETVQRLLPVLCQAHGLTPQQVVAIASHDGGKQALETVQRLLPVLCQAHGLTPEQVVAIA
SNIGGKQALETVQRLLPVLCQAHGLTPQQVVAIASNGGGRPALETVQRLLPVLCQAHGLTPAQVVAIASN
GGGRPALESIVAQLSRPDPALAALTNDHLVALACLGGRPALDAVKKGLPHAPALIKRTNRRIPERTSHRV
ADHAQVVRVLGFFQCHSHPAQAFDDAMTQFGMSRHGLLQLFRRVGVTELEARSGTLPPASQRWDRILQAS
GMKRAKPSPTSTQTPDQASLHAFADSLERDLDAPSPMHEGDQTRASSRKRSRSDRAVTGPSAQQSFEVRV
PEQRDALHLPLSWRVKRPRTSIGGGLPDPGTPTAADLAASSTVMREQDEDPFAGAADDFPAFNEEELAWL
MELLPQ SEQ ID NO: 150
>gi|207722541|ref|YP_002252977.1|type III effector protein (partial sequence central part) [*Ralstonia solanacearum* MolK2]
XXXAKYHATLAGQGFTHADICRISRRWQSLRVVANNYPELMAALPRLTTAQIVDIARQRSGDLALQALLP
VAAALTAAPLGLSASQIATVAQYGERPAIQALYRLRRKLTRAPLGLTPQQVVAIASNTGGKQALEAVTVQ
LRVLRGARYGLSTEQVVAVASNKGGKQALAAVEAQLLRLRAAPYELSTEQVVAVASHNGGKQALEAVRAQ
LLDLRAAPYELSTEQVVAIASHNGGKQALEAVRAQLPALRAAPYGLSTEQVVAIASHNGGKQALEAVRAQ
LPALRAAPYGLSTEQVVAIASNNGGKQALEAVKAQLPVLRRAPYGLSTEQVVAIASNGGGKQALEGIGKQ
LQELRAAPHGLSTAQVATIASSIGGRQALEAVKVQLPVLRAAPYGLTIAQVVAVASHNGGKQALEAIGAQ
LLALRAAPYALSTAQVVAIASNDGGKQALEEVDLPVLALRAAPYELSSAQVIAIAAGNDGGGKQALEAVK
AQLPVLRAAPYEXXXXXXXXXXXX SEQ ID NO: 151
>gi|207722924|ref|YP_002253357.1|avrbs3 family type III effector protein
[*Ralstonia solanacearum* MolK2]
MRRRTAVGRVPGASRSGTSPLVLSQPLSRVSASPQPARSSAISSPNFSAGNPTAFANPSPSLPPTPVLPP
TPVLYAMARELEELHNATWQPAVPLTAEPLADARRDNTVVDGGSGSSPAIASARPQAFAGPPRAPRSARA
RRARTAGDAWPAPAYLGPSPSPSPSPSPSPRIAPDLSGKLAALGYSREQIRKLKQESLAEVAKYHATLAG
QGFTHADICRISRRWQSLRVVANNYPELMAALPRLTTAQIVDIARQRSGDLALQALLPVAAALTAAPLGL
SASQIATVAQYGERPAIQALYRLRRKLTRAPLGLTPQQVVAIASNTGGKQALEAVTVQLRVLRGARYGLS
TEQVVAVASNKGGKQALAAVEAQLLRLRAAPYELSTEQVVAVASHNGGKQALEAVRAQLLDLRAAPYELS
TEQVVAIASHNGGKQALEAVRAQLPALRAAPYGLSTEQVVAIASHNGGKQALEAVKAQLPVLRRAPYGLS
TEQVVAIASNGGGKQALEGIGKQLQELRAAPHGLSTAQVATIASSIGGRQALEAVKVQLPVLRAAPYGLT
IAQVVAVASHNGGKQALEAIGAQLLALRAAPYALSTAQVVAIASNDGGKQALEEVEAQLLALRAAPYELS
SAQVIAIAAGNDGGGKQALEAVKAQLPVLRAAPYELSVAQVVTIASHNGGKQALEAVRAQLLALRAAPYG
LSTAQVVAVAGRNGGKQALEAVRAQLPALRAAPYGLSIAQVVAVASRSGGKQALEAVRAQLLALRAAPYG
LSTAQVVAVASGSGGKPALEAVRAQLLALRAAPYGLSTAQVVAVASHDGGKPALEAVRKQLPVLRGVPHQ
LSIAQVIAIACIGGRQALTAIEMHMLALRAAPYNLSPERVVAIVCIGGRSAVEAIRHGLPVKRIQRIRRR
KAPEATPPAGPFGPTPQELVAVLHFFRAHRQPRHAFVDALTEFQITRAALLRLLSSAGVTEIEALGGTIP
DAAERWQRLLGRLGTRQAIGVAAPSPDSLQGFAQSLERSMLSPGIAEQSASPPPRERPAETAIAPRSNTG
RPSEPWLDQPAWSQHRKRTVRSRMRADAVANMPANPHRDARAQFTPGCLPPAPGPMPAHISPASAGSSSH
VASGSVLPDPGTPTGSDLAMLEAESFGAAALAFDFDSFLQMLDV SEQ ID NO: 152
>gi|222107815|gb|ACM44927.1|avirulence protein Avrxa5 [*Xanthomonas oryzae* pv. *oryzae*]
MDPIRSRTPSPARELLPGPQPDRVQPTADRGGAPPAGGPLDGLPARRTMSRTRLPSPPAPSPAFSAGSFS
DLLRQFDPSLLDTSLLDSMPAVGTPHTAAAPAEWDEAQSGLRAADDPPPTVRVAVTAARPPRAKPAPRRR
AAQPSDASPAAQVDLRTLGYSQQQQEKIKPKVRSTVARHHEALVGHGFTHAHIVALSQHPAALGTVAVTY
QDIIRALPEATHEDIVGVGKQWSGARALEALLTEAGELRGPPLQLDTGQLLKIAKRGGVTAVKAVHAWRN
ALTGAPLNLTPAQVVAIASHDGGNQALETVQRLLPVLCQDHGLTPAQVVAIASHDGGKQALETVQRLLPV
LCQDHGLTPDQVVAIASHDGGKQALETVQRLLPVLCQDHGLTPAQAVAIASNGGGKQALETVQRLLPVLC
QDHGLTPDQVVAIASNGGKQALETVQRLLPVLCQDHGLTPDQVVAIASNNGGKQALETVQRLLPVLCQDH
GLTPDQVVAIASHDGGKQALETVQRLLPVLCQDHGLTPDQVVAIASHDGGKQALETVQRLLPVLCQDHGL
TPDQVVAIASNGGKQALETVQRLLPVLCQDHGLTLAQVVAIASNIGGKQALETVQRLLPVLCQDHGLTPD
QVVAIASNNGGKQALETVQRLLPVLCQDHGLTPDQVVAIASHDGGKQALETVQRLLPVLCQDHGLTPAQV
VAIASHIGGKQALETVQRLLPVLCQDHGLTLDQVVAIASNDGSKQALETVQRLLPVLCQDHGLTPDQVVA
IASHDGGKQALETVQRLLPVLCQDHGLTPNQVVAIASNIGGKQALETVQRLLPVLCQAHGLTPDQVVAIA
SHDGGKQALETVQRLLPVLCQNHGLTPDQVVAIASHDGGKQALETVQRLLPVLCQNHGLTPDQVVAIASN
GGGKQALETVQRLLPVLCQDHGLTPDQVVAIASNGGGKQALESIVAQLSRPDPALAALTNDHLVALACLG
GRPALDAVKKGLPHAPELIRRINRRIPERTSHRVADYAQVVRVLEFFQCHSHPAYAFDEAMTQFGMSRNG
LVQLFRRVGVTELEARCGTLPPASQRWDRILQASGMKRAKPSPTSAQTPDQASLHAFADSLERDLDAPSP
MHEGDQTRASSRKRSRSDRAVTGPSAQQSFEVRVPEQRDALHLPLSWRVKRQRTRIGGGLPDPGTPIAAD
LAASSTVMWEQDAAPFAGAADDFPAFNEEELAWLMELLPQSGSVGGTI SEQ ID NO: 153
>gi|224184745|gb|ACN39605.1|avrTaw [*Xanthomonas citri* subsp. *citri*]
AWRNALTGAPLNLTPEQVVAIASNIGGKQALETVQRLLPVLCQAHGLTPDQVVAIASNGGKQALETVQRL
LPVLCQAHGLTPAQVVAIASNIGGKQALETVQRLLPVLCQAHGLTPDQVVAIASNIGGKQALETVQRLLP
VLCQAHGLTPEQVVAIASHDGGKQALETVQRLLPVLCQAHGLTPEQVVAIASNIGGKQALETVQRLLPVL
CQAHGLTPEQVVAIASHDGGKQALETVQRLLPVLCQAHGLTPEQVVAIASHDGGKQALETVQRLLPVLCQ
AHGLTPEQVVAIASHDGGKQALETVQRLLPVLCQAHGLTPEQVVAIASNGGKQALETVQRLLPVLCQAHG
LTPAQVVAIASHDGGKQALETVQRLLPVLCQAHGLTPEQVVAIASNSGGKQALETVQRLLPVLCQAHGLT
PAQVVAIASNIGGKQALETVQRLLPVLCQAHGLTPEQVVAIASHDGGKQALETVQRLLPVLCQAHGLTPA
QVVAIASNIGGKQALETVQRLLPVLCQAHGLTPEQVVAIASNGGKQALETVQRLLPVLCQAHGLTPEQVV TABLE 1-continued

| Endogenous TALE Polypeptide Sequences |
|---|
| AIASNIGGKQALETVQRLLPVLCQAHGLTPEQVVAIASNSGGKQALETVQRLLPVLCQAHGLTPEQVVAI ASNGGGRPALESIVAQLSRPDPALAALTNDHLVALACLGGRPALDAVKKGLPHAPALIKRTNRRIPERTS HRVADHAQVVRVLGFFQCHSHPAQAFDDAMTQFGMSRHGLLQLFRRVGVTELEARSGTLPPASQRWDRIL QASGMKRAKPSPTSTQTPDQASLHA |
| SEQ ID NO: 154<br>>gi\|225200251\|gb\|ACN82432.1\|AvrBs3-like protein [*Xanthomonas axonopodis* pv. *glycines*]<br>MDPIRSRTPSPARELLPGPQPDRVQPTADRGVSPPAGGPLDGLPARRTMSRTRLPSPPAPSPAFSAGSFS DLLRQSDPSLLDTSIFDSMPAVGTPHTEAATGEWDEVQSGLRAADAPPPTMRVAVTAARSPRANPAPRRR AAQPSDASPAAQVDLRTLGYSQQQQEKIKPKVRSTVAQHHEALVGHGFTHAHIVALGQHPAALGTVAVKY QDMIAALPEATHEAIVGVGKQWSGARALEALLTVAGELRGPPLQLDTGQLLKIAKRGGVTAVEAVHAWRN ALTGAPLNLTPEQVVAIARNIGGKQALETVQRLLPVLCQAHGLTPEQVVAIASNSGGKQALETVQRLLPV LCQAHGLTPEQVVAIASHDGGKQALETVQRLLPVLCQAHGLTPAQVVAIASNGGGKQALETVQRLLPVLC QAHGLTPEQVVAIASHDGGKQALETVQRLLPVLCQAHGLTPAQVVAIASNGGGKQALETVQRLLPVLCQA HGLTPAQVVAIASNGGGKQALETVQRLLPVLCQAHGLTPAQVVAIASHDGGKQALETVQRLLPVLCQAHG LTPEQVVAIASNIGGKQALETVQRLLPVLCQAHGLTPQQVVAIASNGGGRPALETVQRLLPVLCQAHGLT PEQVVAIASNIGGKQALETVQRLLPVLCQAHGLTPQQVVAIASNGGGRPALETVQRLLPVLCQAHGLTPE QVVAIASNIGGKQALETVQRLLPVLCQAHGLTPQQVVAIASNGGGRPALETVQRLLPVLCQAHGLTPEQV VAIASNIGGKQALETVQRLLPVLCQAHGLTPQQVVAIASHDGGKQALETVQRLLPVLCQAHGLTPEQVVA IASNIGGKQALETVQRLLPVLCQAHGLTPQQVVAIASHDGGKQALETVQRLLPVLCQAHGLTPEQVVAIA SNIGGKQALETVQRLLPVLCQAHGLTPQQVVAIASNGGGRPALETVQRLLPVLCQAHGLTPAQVVAIASN GGGRPALESIVAQLSRPDPALAALTNDHLVALACLGGRPALDAVKKGLPHAPALIKRTNRRIPERTSHRV ADHAQVVRVLGFFQCHSHPAQAFDDAMTQFGMSRHGLLQLFRRVGVTELEARSGTLPPASQRWDRILQAS GMKRAKPSPTSTQTPDQASLHAFADSLERDLDAPSPMHEGDQTRASSRKRSRSDRAVTGPSAQQSFEVRV PEQRDALHLPLSWRVKRPRTSIGGGLPDPGTPTAADLAASSTVMREQDEDPFAGAADDFPAFNEEELAWL MELLPQ |
| SEQ ID NO: 155<br>>gi\|270155233\|gb\|ACZ62652.1\|PthAf [*Xanthomonas axonopodis* pv. *citri*]<br>MDPIRSRTPSPARELLPGPQPDGVQPTADRGVSPPAGGPLDGLPARRTISRTRLPSPPAPSPAFSAGSFS DLLRQFDPSLFNTSLFDSLPPFGAHHTEAATGEWDEVQSGLRAADAPPPTMRVAVTAARPPRAKPAPRRR AAQPSDASPAAQVDLRTLGYSQQQQEKIKPKVRSTVAQHHEALVGHGFTHAHIVALSQHPAALGTVAVKY QDMIAALPEATHEAIVGVGKQWSGARALEALLTVAGELRGPPLQLDTGQLLKIAKRGGVTAVEAVHAWRN ALTGASLNLTPEQVVAIASNIGGKQALETVQRLLPVLCQAHGLTPEQVVAIASNGGKQALETVQRLLPVL CQAHGLTPEQVVAIASNIGGKQALETVQRLLPVLCQAHGLTPEQVVAIASNIGGKQALETVQRLLPVLCQ AHGLTPAQVVAIASNIGGKQALETVQRLLPVLCQAHGLTPEQVVAIASHDGGKQALETVQRLLPVLCQAH GLTPDQVVAIASHDGGKQALETVQRLLPVLCQAHGLTPQQVVAIASNGGGKQALETVQRLLPVLCQAHGL TPEQVVAIASHDGGKQALETVQRLLPVLCQAHGLTPEQVVAIASNGGGKQALETVQRLLPVLCQAHGLTP EQVVAIASNGGGKQALETVQRLLPVLCQAHGLTPEQVVAIASNGGGKQALETVQRLLPVLCQAHGLTLDQ VVAIASNGGGKQALETVQRLLPVLCQAHGLTPEQVVAIASNGGGKQALETVQRLLPVLCQAHGLTPEQVV AIASHDGGKQALETVQRLLPVLCQAHGLTPEQVVAIASHDGGKQALETVQRLLPVLCQAHGLTPEQVVAI ACNGGGKQALETVQRLLPVLCQAHGLTPEQVVAIASNGGGRPALESIVAQLSRPDPALAALTNDHLVALA CLGGRPALDAVKKGLPHAPALIKRTNRRIPERTSHRVADHAQVVRVLGFFQCHSHPAQAFDDAMTQFGMS RHGLLQLFRRVGVTELEARSGTLPPASQRWDRILQASGMKRAKPSPTSTQTPDQASLHAFADSLERDLDA PSPTHEGDQRRASSRKRSRSDRAVTGPSAQQSFEVRVPEQRDALHLPLSWRVKRPRTSIGGGLPDPGTPT AADLAASSTVMREQDEDPFAGAADDFPAFNEEELAWLMELLPQ |
| SEQ ID NO: 156<br>>gi\|270155235\|gb\|ACZ62653.1\|PthA [*Xanthomonas axonopodis* pv. *citri*]<br>MDPIRSRTPSPARELLPGPQPDGVQPTADRGVSPPAGGPLDGLPARRTMSRTRLPSPPAPSPAFSAGSFS DLLRQFDPSLFNTSLFDSLPPFGAHHTEAATGEWDEVQSGLRAADAPPPTMRVAVTAARPPRAKPAPRRR AAQPSDASPAAQVDLRTLGYSQQQQEKIKPKVRSTVAQHHEALVGHGFTHAHIVALSQHPAALGTVAVKY QDMIAALPEATHEAIVGVGKQWSGARALEALLTVAGELRGPPLQLDTGQLLKIAKRGGVTAVEAVHAWRN ALTGAPLNLTPEQVVAIASNIGGKQALETVQRLLPVLCQAHGLTPEQVVAIASNGGKQALETVQRLLPVL CQAHGLTPEQVVAIASNIGGKQALETVQRLLPVLCQAHGLTPEQVVAIASNIGGKQALETVQRLLPVLCQ AHGLTPAQVVAIASNIGGKQALETVQRLLPVLCQAHGLTPEQVVAIASHDGGKQALETVQRLLPVLCQAH GLTPDQVVAIASHDGGKQALETVQRLLPVLCQAHGLTPQQVVAIASNGGGKQALETVQRLLPVLCQAHGL TPEQVVAIASHDGGRQALETVQRLLPVLCQAHGLTPEQVVAIASNGGGKQALETVQRLLPVLCQAHGLTP EQVVAIASNGGGKQALETVQRLLPVLCQAHGLTPEQVVAIASNGGGKQALETVQRLLPVLCQAHGLTLDQ VVAIASNGGGKQALETVQRLLPVLCQAHGLTPEQVVAIASNSGGKQALETVQRLLPVLCQAHGLTPDQVV AIASHDGGKQALETVQRLLPVLCQAHGLTPEQVVAIASHDGGKQALETVQRLLPVLCQAHGLTPEQVVAI ACNGGGKQALETVQRLLPVLCQAHGLTPEQVVAIASNGGGRPALESIVAQLSRPDPALAALTNDHLVALA CLGGRPALDAVKKGLPHAPALIKRTNRRIPERTSHRVADHAQVVRVLGFFQCHSHPAQAFDDAMTQFGMS RHGLLQLFRRVGVTELEARSGTLPPASQRWDRILQASGMKRAKPSPTSTQTPDQASLHAFADSLERDLDA PSPTHEGDQRRASSRKRSRSDRAVTGPSAQQSFEVRVPEQRDALHLPLSWRVKRPRTSIGGGLPDPGTPT AADLAASSTVMREQDEDPFAGAADDFPAFNEEELAWLMELLPQ |
| SEQ ID NO: 157<br>>gi\|294626763\|ref\|ZP_06705357.1\|type III secretion system effector protein [*Xanthomonas fuscans* subsp. *aurantifolii* str. ICPB 11122]<br>MGHGFTRAHIVALSQHPAALGTVAVKYQAMIAALPEATHEDIVGVGKQWSGARALEALLTVSGELRGPPL QLDTGQLLKIAKRGGVTAVEAVHAWRNALTGAPLNLTPDQVVAIASHDGGKQALETVQRLLPVLCEQHGL TPAQVVAIASNGGGKQALETVQQLLPVLCEQHGLTPDQVVAIASHDGGKQALETVQRLLPVLCEQHGLTP AQVVAIASNGGGKQALETVQQLLPVLCEQHGLTPDQVVAIASNIGGKQALETVQRLLPVLCEQHGLTPAQ VVAIASNGGGKQALKTVQQLLPVLCEQHGLTPDQVVAIASHDGGKQALETVQRLLPVLCEQHGLTPDQVV AIASNGGGKQALETVQRLLPVLCEQHGLTPDQVVAIASNGGGKQALETVQRLLPVLRQAHGLTPAQVVAI ASNGGGRPALESIFAQLSRPDQALAALTNDHLVALACLGGRPALEAVKKGLPHAPTLIKRTNRRLPERTS |

TABLE 1-continued

| Endogenous TALE Polypeptide Sequences |
| --- |
| HRVADHAQVARVLGFFQCHSHPAQAFDEAMTQFGMSRHGLLQLFRRVGVTELEARGGTLPPAPQRWHRIL<br>QASGMKRAEPSGASAQTPDQASLHAFADALERELDAPSPIDQAGQALASSSRKRSRSESSVTGSFAQQAV<br>EVRVPEQRDALHLPPLSWGVKRPRTRIGGGLPDPGTPMDADLAASSTVMWEQDADPFAGAADDFPAFNEE<br>EMAWLMELFPQ |
| SEQ ID NO: 158<br>>gi\|294627812\|ref\|ZP_06706392.1\|type III secretion system effector protein [*Xanthomonas fuscans* subsp. *aurantifolii* str. ICPB 11122]<br>MGHGFTHAHIVALSQHPAALGTVAVKYQAMIAALPEATHEDIVGVGKQWSGARALEALLTVSGELRGPPL<br>QLDTGQLLKIAKRGGVTAVEAVHAWRNALTGAPLNLTPDQVVAIASNGGGKQALETVQRLLPVLCEQHGL<br>TPDQVVAIASNGGGKQALETVQRLLPVLCEQHGLTPDQVVAIASNGGGKQALETVQRLLPVLCEQHGLTP<br>DQVVAIASNGGGKQALETVQRLLPVLCEQHGLTPDQVVAIASNGGGKQALETVQRLLPVLCEQHGLTPDQ<br>VVAIASNGGGKQALETVQRLLPVLCEQHGLTPAQVVAIASNIGGKQALETVQRLLPVLCEQHGLTPDQVV<br>AIASHDGGKQALETVQRLLPVLCEQHGLTPDQVVAIASNGGGKQALETVQRLLPVLCEQHGLTPDQVVAI<br>ASNGGGKQALETVQRLLPVLCKQHGLTPDQVVAIASNNGGKQALETVQRLLPVLCEQHGLTPAQVVAIAS<br>NNGGKQALETVQRLLPVLCEQHGLTPAQVVTIASNNGGKQALETVQRLLPVLCEQHGLTPAQVVAIASNG<br>GGRPALESIFAQLSRPDQALAALTNDHLVALACLGGRPALEAVKKGLPHAPTLIKRTNRRLPERTSHRVA<br>DHAQVARVLGFFQCHSHPAQAFDEAMTQFGMSRHGLLQLFRRAGVTELEAHSGTLPPASQRWHRILQASG<br>MKRAEPSGASAQTPDQASLHAFADALERELDAPSPIDRAGQALASSSRKRSRSESSVTSSFAQQAVEVRV<br>PEQRDALHFLPLSWGVKRPRTRIGGGLPDPGTPMDADLAPSSTVMWEQDADPFAGAADDFPAFNEEEMAW<br>LMELFPQ |
| SEQ ID NO: 159<br>>gi\|294664940\|ref\|ZP_06730254.1\|type III secretion system effector protein [*Xanthomonas fuscans* subsp. *aurantifolii* str. ICPB 10535]<br>MLCEQHGLTPDQVVAIASNIGGKQALETVQRLLPVLCEQHGLTPDQVVAIASNGGGKQALETVQRLLPVL<br>CEQHGLTPDQVVAIASNIGGKQALETVQRLLPVLCEQHGLTPDQVVAIASNIGGKQALETVQRLLPVLCE<br>QHGLTPDQVVAIASHDGGKQALETVQRLLPVLCEQHGLTPDQVVAIASHDGGKQALETVQRLLPVLCEQH<br>GLTPDQVVAIASHDGGKQALETVQRLLPVLCEQHGLTPDQVVAIASHDGGKQALETVQRLLPVLCEQHGL<br>TPDQVVAIASHDGGKQALETVQRLLPVLRQAHGLTPAQVVAIASHDGGKQALETVQRLLPVLCEQHGLTP<br>DQVVAIASNGGGRPALETVQRLLPVLCEQHGLTPDQVVAIASNGGGKQALETVQRLLPVLCEQHGLTPAQ<br>VVAIASNGGGRPALESIFAQLSRPDQALAALTNDHLVALACLGGRPALEAVKKGLPHAPTLIKRTNRRLP<br>ERTSHRVADHAQVARVLGFFQCHSHPAQAFDEAMTQFGMSRHGLLQLFRRAGVTELEAHSGTLPPASQRW<br>HRILQASGMKRAEPSGASAQTPDQASLHAFADALERELDAPSPIDRAGQALASSSRKRSRSESSVTGSFA<br>QQAVEVRVPEQRDALHFLPLSWGVKRPRTRIGGGLPDPGTPMDADLAPSSTVMWEQDADPFAGAADDFPA<br>FNEEEMAWLMELFPQ |
| SEQ ID NO: 160<br>>gi\|294666241\|ref\|ZP_06731493.1\|type III secretion system effector protein [*Xanthomonas fuscans* subsp. *aurantifolii* str. ICPB 10535]<br>MSAFGAPHTEAAPGEADEVQSGLRAVDDPHPTVHVAVTAARPPRAKPAPRRRAAHTSDASPAGQVDLCTL<br>GYSQQQQDEIKPKARATVAQHHQALMGHGFTRAHIVALSQHPAALGTVAVKYQAMIAALPEATHEDIVGV<br>GKQWSGARALEALLTVSGELRGPPLQLDTGQLLKIAKRGGVTAVEAVHAWRNALTGAPLNLTPDQVVAIA<br>SHDGGKQALETVQRLLPVLCEQHGLTPDQVVAIASNGGGKQALETVQRLLPVLCEQHGLTPDQVVAIASH<br>DGGKQALETVQRLLPVLCEQHGLTPDQVVAIASHDGGKQALETVQRLLPVLCEQHGLTPDQVVAIASNIG<br>GKQALETVQRLLPVLCEQHGLTPDQVVAIASNGGGKQALETVQRLLPVLCEQHGLTPDQVVAIASNIGGK<br>QALETVQRLLPVLCEQHGLTPAQVVAIASNGGGKQALETVQQLLPVLCEQHGLTPDQVVAIASNIGGKQA<br>LETVQRLLPVLCEQHGLTPDQVVAIASNIGGKQALETVQRLLPVLCEQHGLTPDQVVAIASHDGGKQALE<br>TVQRLLPVLCEQHGLTPDQVVAIASNGGGKQALETVQRLLPVLCEQHGLTPDQVVAIASHDGGKQALETV<br>QRLLPVLCEQHGLTPDQVVAIASHDGGKQALETVQRLLPVLRQAHGLTPAQVVAIASHDGGKQALETVQR<br>LLPVLCEQHGLTPDQVVAIASNGGGKQALETVQRLLPVLCEQHGLTPDQVVAIASNGGGKQALETVQRLL<br>PVLRQAHGLTPAQVVAIASNGGGRPALESIFAQLSRPDQALAALTNDHLVALACLGGRPALEAVKKGLPH<br>APTLIKRTNRRLPERTSHRVADHAQVARVLGFFQCHSHPAQAFDEAMTQFGMSRHGLLQLFRRVGVTELE<br>ARGGTLPPAPQRWHRILQASGMKRAEPSGASAQTPDQASLHAFADALERELDAPSPIDQAGQALASSSRK<br>RSRSESSVTGSFAQQAVEVRVPEQRDALHLPPLSWGVKRPRTRIGGGLPDPGTPMDADLAASSTVMWEQD<br>ADPFAGAADDFPAFNEEEMAWLMELFPQ |
| SEQ ID NO: 161<br>>gi\|294666411\|ref\|ZP_06731656.1\|type III secretion system effector protein [*Xanthomonas fuscans* subsp. *aurantifolii* str. ICPB 10535]<br>MDPIRPRTSSPAHELLAGPQPDRVQPQPTADRGGAPPAGSPLDGLPARRTMSRTRLPSPPAPLPAFSAGS<br>FSDLLCQFDPLLLDTLLFDSMSAFGAPHTEAAPGEADEVQSGLRAVDDPHPTVHVAVTAARPPRAKPAPR<br>RRAAHTSDASPAGQVDLCTLGYSQQQQDEIKPKARATVAQHHQALMGHGFTRAHIVALSQHPAALGTVAV<br>KYQAMIAALPEATHEDIVGVGKQWSGARALEALLTVSGELRGPPLQLDTGQLLKIAKRGGVTAVEAVHAW<br>RNALTGAPLNLTPDQVVAIASNIGGKQALETVQRLLPVLCEQHGLTPDQVVAIASNGGGKQALETVQRLL<br>PVLCEQHGLTPDQVVAIASNIGGKQALETVQRLLPVLCEQHGLTPDQVVAIASNGGGKQALETVQRLLPV<br>LCEQHGLTPDQVVAIASNIGGKQALETVQRLLPVLCEQHGLTPDQVVAIASNIGGKQALETVQRLLPVLC<br>EQHGLTPDQVVAIASHDGGKQALETVQRLLPVLCEQHGLTPDQVVAIASHDGGKQALETVQRLLPVLCEQ<br>HGLTPDQVVAIASHDGGKQALETVQRLLPVLCEQHGLTPDQVVAIASNIGGKQALETVQRLLPVLCEQHG<br>LTPDQVVAIASHDGGKQALETVQRLLPVLCEQHGLTPDQVVAIASNGGGKQALETVQRLLPVLCEQHGLT<br>PDQVVAIASNGGGRPALETVQRLLPVLCEQHGLTPDQVVAIASNGGGKQALETVQRLLPVLCEQHGLTPA<br>QVVAIASNGGGRPALESIFAQLSRPDQALAALTNDHLVALACLGGRPALEAVKKGLPHAPTLIKRTNRRL<br>PERTSHRVADHAQVARVLGFFQCHSHPAQAFDEAMTQSG |

TABLE 1-continued

| Endogenous TALE Polypeptide Sequences |
|---|

SEQ ID NO: 162
>gi|294668037|ref|ZP_06733167.1|type III secretion system effector protein [*Xanthomonas fuscans* subsp. *aurantifolii* str. ICPB 10535]
MAIASNIGGKQALETVQRLLPLLCEQHGLTPDQVVAIASNVGGKQALETVQRLLPVLCEQHGLTPDQVVA
IASNIGGKQALETVQRLLPVLCEQHGLTPAQVVAIASNGGGKQXXPSIELLTLSASRSGGDTDLLLIFY SEQ ID NO: 163
>gi|297613851|gb|ADI48327.1|avirulence protein PthC1 [*Xanthomonas axonopodis* pv. *aurantifolii*]
MDPIRPRTSSPAHELLAGPQPDRVQPQPTADRGGAPPAGSPLDGLPARRTMSRTRLPSPPAPLPAFSAGS
FSDLLCQFDPLLLDTLLFDSMSAFGAPHTEAAPGEADEVQSGLRAVDDPHPTVHVAVTAARPPRAKPAPR
RRAAHTSDASPAGQVDLCTLGYSQQQQDEIKPKARATVAQHHQALMGHGFTRAHIVALSQHPAALGTVAV
KYQAMIAALPEATHEDIVGVGKQWSGARALEALLTVSGELRGPPLQLDTGQLLKIAKRGGVTAVEAVHAW
RNALTGAPLNLTPDQVVAIASHDGGKQALETVQRLLPVLCEQHGLTPDQVVAIASNGGGKQALETVQRLL
PVLCEQHGLTPDQVVAIASHDGGKQALETVQRLLPVLCEQHGLTPDQVVAIASHDGGKQALETVQRLLPV
LCEQHGLTPDQVVAIASNIGGKQALETVQRLLPVLCEQHGLTPDQVVAIASNGGGKQALETVQRLLPVLC
EQHGLTPDQVVAIASNIGGKQALERVQRLLPVLCEQHGLTPAQVVAIASNGGGKQALETVQQLLPVLCEQ
HGLTPDQVVAIASNIGGKQALETVQRLLPVLCEQHGLTPDQVVAIASNIGGKQALETVQRLLPVLCEQHG
LTPDQVVAIASHDGGKQALETVQRLLPVLCEQHGLTPDQVVAIASNGGGKQALETVQRLLPVLCEQHGLT
PDQVVAIASHDGGKQALETVQRLLPVLCEQHGLTPDQVVAIASHDGGKQALETVQRLLPVLRQAHGLTPA
QVVAIASHDGGKQALETVQRLLPVLCEQHGLTPDQVVAIASNGGGKQALETVQRLLPVLCEQHGLTPDQV
VAIASNGGGKQALETVQRLLPVLRQAHGLTPAQVVAIASNGGGRPALESIFAQLSRPDQALAALTNDHLV
ALACLGGRPALEAVKKGLPHAPTLIKRTNRRLPERTSHRVADHAQVARVLGFFQCHSHPAQAFDEAMTQF
GMSRHGLLQLFRRVGVTELEARGGTLPPAPQRWHRILRASGMKRAEPSGASAQTPDQASLHAFADALERE
LDAPSPIDQAGQALASSSRKRSRSESSVTGSFAQQAVEVRVPEQRDALHLPPLSWGVKRPRTRIGGGLPD
PGTPMDADLAASSTVMWEQDADPFAGAADDFPAFNEEEMAWLMELLPQ SEQ ID NO: 164
>gi|297613853|gb|ADI48328.1|avirulence protein PthC2 [*Xanthomonas axonopodis* pv. *aurantifolii*]
MDPIRPRTSSPAHELLAGPQPDRVQPQPTADRGGAPPAGSPLDGLPARRTMSRTRLPSPPAPLPAFSAGS
FGDLLCQFDPLLLDTLLFDSMSAFGAPHTEAAPGEADEVQSGLRAVDDPHPTVHVAVTAARPPRAKPAPR
RRAAHTSDASPAGQVDLCTLGYSQQQQDEIKPKARATVAQHHQALMGHGFTRAHIVALSQHPAALGTVAV
KYQAMIAALPEATHEDIVGVGKQWSGARALEALLTVSGELRGPPLQLDTGQLLKIAKRGGVTAVEAVHAW
RNALTGAPLNLTPDQVVAIASNIGGKQALETVQRLLPVLCEQHGLTPDQVVAIASNIGGKQALETVQRLL
PVLCEQHGLTPDQVVAIASNIGGKQALETVQRLLPVLCEQHGLTPDQVVAIASNGGGKQALETVQRLLPV
LCEQHGLTPDQVVAIASNIGGKQALETVQRLLPVLCEQHGLTPDQVVAIASNIGGKQALETVQRLLPVLC
EQHGLTPDQVVAIASHDGGKQALETVQRLLPVLCEQHGLTPDQVVAIASHDGGKQALETVQRLLPVLCEQ
HGLTPDQVVAIASHDGGKQALETVQRLLPVLCEQHGLTPDQVVAIASNIGGKQALETVQRLLPVLCEQHG
LTPDQVVAIASHDGGKQALETVQRLLPVLCEQHGLTPDQVVAIASNGGGKQALETVQRLLPVLCEQHGLT
PDQVVAIASNGGGRPALETVQRLLPVLCEQHGLTPDQVVAIASNGGGKQALETVQRLLPVLCEQHGLTPA
QVVAIASNGGGRPALESIFAQLSRPDQALAALTNDHLVALACLGGRPALEAVKKGLPHAPTLIKRTNRRL
PERTSHRVADHAQVARVLGFFQCHSHPAQAFDEAMTQFGMSRHGLLQLFRRAGVTELEAHSGTLPPASQR
WHRILQASGMKRAEPSGASAQTPDQASLHAFADALERELDAPSPIDRAGQALASSSRKRSRSESSVTGSF
AQQAVEVRVPEQRDALHFLPLSWGVKRPRTRIGGGLPDPGTPMDADLAPSSTVMWEQDADPFAGAADDFP
AFNEEEMAWLMELLPQ SEQ ID NO: 165
>gi|300694519|ref|YP_003750492.1|type III effector; avrbs3 family [*Ralstonia solanacearum* PSI07]
MAALGYSREQIRKLKQESLSGVAKYHAPLTRHGFTHTDICRISRRWQSLRMVAKNYPKLIAALPDLTRTH
IVDIARQRSGDLALEALLPVATALAAAPLRLRASQIAIIAQCGERPAILALHRLRRKLTGAPLNLTPQQV
VAIAANTGGKQALGAITTQLPILRAAPYELSPEQVVAIASNNGGKPALEAVKAQLLELRAAPYELSPEQV
VAIASNNGGKPALEAVKALLLALRAAPYELSTEQVVAIASNNGGKPALEAVKALLLELRAAPYELSTGQV
VAIASNGGGRQALEAVREQLLALRAVPYELSTEQVVVIANSIGGKQALEAVKVQLPVLRAAPYELNTEQV
VAVASNKGGKQALEAVGAQLLALRAVPYALTTAQVVAIASNDGGKQALEAVGAQLLVLRAVPYELTTAQV
VAIASNDGGKQTLEVAGAQLLALRAVPYELSTEQVVAIASNNGGKQALEAVKTQLLALRTAPYELSTEQV
VAIASNNGGKQALEAVKAQLPALRAAPYELSTEQVVAIASNNGGKQALEAVKAQLLVLRAAPYGLSTAQV
VAIAANNGGKQALEAVRALLPVLRVAPYELSTTRVVSIACIGGRQALEAIKTHMPALRQAPYSLSHERVV
AIVCIGGRSALEAARHGLPVRDIRRIRNRKTSDATLPAPVLGPTPQELVAVLHFFRTHQQPRQAFVDALT
AFQTTRRALLRLLSSAGVTEIEALGGMIPDAAERWQRLLGRLGIRPATDTVVTSPDPMQGFAQSLERSLM
SSGTTEQSASPSQHRWPAGTAKTPESARHRLDNAAQPPMQWPDQLVWSQRRRCTASSQTPPPGAASVPAN
LQWGARAQRTSSRLQPELRPMPARVVPASAQPSPLGDLEFGLPDPGTPTAADLALDLDWLLQLLDL SEQ ID NO: 166
>gi|305677557|pdb|2KQ5|A Chain A, Solution Nmr Structure Of A Section Of The Repeat Domain Of The Type Iii Effector Protein Ptha
EQVVAIASNIGGKQALETVQRLLPVLCQAHGLTPEQVVAIASHDGGKQALE SEQ ID NO: 167
>gi|306022299|gb|ADM80412.1|TAL effector protein [*Xanthomonas axonopodis*
pv. *manihotis*]
MDPIRPRTPSPAHELLAGPQPDRVQPQPTADRGGAPPAGSPLDGLPARRTMSRTRLPSPPAPLPAFSAGS
FSDLLRQFDPSLLDTSLFNSMSAFGAPHTEAASGEGDEVQSGLRAADDPQATVQVAVTAARPPRAKPAPR
RRAAHTSDASPAGQVDLCTLGYSQQQQEKIKLKARSTVAQHHEALIGHGFTRAHIVALSQHPAALGTVAV
KYQAMIAALPEATHEDIVGGGKQWSGARALEALLTVSGELRGPPLQLDTGQLLKIAKRGGVTAVEAVHAW TABLE 1-continued

| Endogenous TALE Polypeptide Sequences |
|---|
| RNALTGAPLNLTPDQVVAIASNIGGKQALETVQRLLPVLCEQHGLTLDQVVAIASNGGGKQALETVQRLLPVLCEQHGLTPDQVVAIASNIGGKQALETVQRLLPVLCEQHGLTPDQVVAIASNNGGKQALETVQRLLPVLCEQHGLTPDQVVAIASNIGGKQALETVQRLLPVLRQAHGLTPAQVVAIASHDGGKQALETVQQLLPVLCEQHGLTPAQVVAIASNSGGKQALETVQRLLPVLRQAHGLTPDQVVAIASNSGGKPALETVQRLLPVLCEQHGLTPDQVVAIASNNGGKQALETVQRLLPVLCEQHGLTRAQVVAIASNGGGKQALETVQRLLPVLCEQHGLTPDQVVAIASHDGGKQALETVQRLLPVLRQAHGLTPAQVVAIASNNGGKPALETVQRLLPVLCEQHGLTPDQVVAIASNIGGKQALETVQRLLPVLCEQHGLTPDQVVAIASNGGGKPALESTFAQLSRPDQALAALTNDHLVALACLGGRPALEAVRKGLPHAPTLIKRTNRRLPERTSHRVADHAQVARVLGFFQCHSHPAQAFDEAMTQFGMSRHGLLQLFRRAGVTELEARSGTLPPASQRWHRILQASGMKRAEPSGASAQTPDQASLHAFADALERELDAPSPIDRAGQALASSSRKRSRSESSVTGSFAQQAVEVRVPEQRDALHFLPLSWGVKRPRTRIGGGLPDPGTPMDADLAPSSTVMWEQDADPFAGAADDFPAFNEEEMAWLMELFPQ |

TABLE 2

| Sequences Encoding Monomor Units |
|---|
| Monomer with HD being the 12-13 amino acids: SEQ ID NO: 168 TTGACCCCAGAGCAGGTCGTGGCGATCGCAAGCCACGACGGAGGAAAGCAAGCCTTGGAAACAGTACAGAGGCTGTTGCCTGTGCTGTGCCAAGCGCACGGG |
| Monomer with NI being the 12-13 amino acids: SEQ ID NO: 169 CTGACCCCAGAGCAGGTCGTGGCAATCGCCTCCAACATTGGCGGAAACAGGCACTCGAGACTGTCCAGCGCCTGCTTCCCGTGCTGTGCCAAGCGCACGGA |
| Monomer with NG being the 12-13 amino acids: SEQ ID NO: 170 CTGACCCCAGAGCAGGTCGTGGCCATTGCCTCGAATGGAGGGGGCAAACAGGCGTTGGAAACCGTACAACGATTGCTGCCGGTGCTGTGCCAAGCGCACGGC |
| Monomer with NN being the 12-13 amino acids: SEQ ID NO: 171 CTTACCCCAGAGCAGGTCGTGGCAATCGCGAGCAATAACGGCGGAAAACAGGCTTTGGAAACGGTGCAGAGGCTCCTTCCAGTGCTGTGCCAAGCGCACGGG |
| Divariable Residues Underlined |
| LTPDQVVAIASNSGGKQALETVQRLLPVLCQDHG (SEQ ID NO: 172) |
| LTPDQVVAIANNKGGKQALETLQRLLPVLCQDHG (SEQ ID NO: 173) |
| LTPDQVVAIASHGGGKQALETVQRLLPVLCQDHG (SEQ ID NO: 174) |
| LTPAQVVAIASHHGGKQALETVQRLLPVLCQDHG (SEQ ID NO: 175) |
| LTPYQVVAIASNDGSKQALETVQRLLPVLCQDHG (SEQ ID NO: 176) |

TABLE 2-continued

| Sequences Encoding Monomor Units |
|---|
| LTPDQVVAIANSNGGKQALETVQRLLPVLCQDHG (SEQ ID NO: 177) |
| LTPDQVVAIASYGGGKQALETVQRVLPVLCQDHG (SEQ ID NO: 178) |
| LTPDQVVAIASHNGGKQALETVQRLLPVLCQDHG (SEQ ID NO: 179) |
| LTPDQVVAIASHAGGKQALETVQRLLPVLCQDHG (SEQ ID NO: 180) |
| LTPDQVVAIASSSGGKQALETVQRLLPVLCQDHG (SEQ ID NO: 181) |
| LTLDQVVAIASNAGGKQALETVQRLLPVLCQDHG (SEQ ID NO: 182) |
| LTPDQVVAIANNVGGKQALATVQRLLPVLCQDHG (SEQ ID NO: 183) |
| LTPAQVVAIASHIGGKQALETVQRLLPVLCQDHG (SEQ ID NO: 184) |
| LTPDQVVAIASNQGGKQALATVQRLLPVLCQDHG (SEQ ID NO: 185) |
| LTPDQVVAIANNHGGKQALETVQRLLPVLCQDHG (SEQ ID NO: 186) |
| LTPDQVVAIASNCGGKQALETVQRLLPVLCQDHG (SEQ ID NO: 187) |
| LTREQVVAIASIGGGKQALETVQRLLPVLCQDHG (SEQ ID NO: 188) |
| LTPDQVVAIASNGGGKQALETVQRLLPVLCQDHG (SEQ ID NO: 189) |
| LTPAQVVAIASSGGGKQALETVQRLLPVLCQDHG (SEQ ID NO: 190) |
| LTPDQVVAIASHGGGKQALETVQRLLPVLCQDHG (SEQ ID NO: 191) |

Below: Expression Vector Backbone Sequences for dTALE Polypeptide Expression Encoding Type IIs sites are bracketed in bold, lowercase letters. NLS is double-underlined in lowercase letters. 2A-GFP sequences are single-underlined. The variable diresidue is starred in bold, uppercase letters.

>dTALE-Backbone(NI in 0.5 repeat)-NLS-VP64-2A-EGFP

SEQ ID NO: 192

ATGTCGCGGACCCGGCTCCCTTCCCCACCCGCACCCAGCCCAGCGTTTTCGGCCGACTCGTTCTCAGACCTGCTTAGGCAGTTCGACCCCTCACTGTTTAACACATCGTTGTTCGACTCCCTTCCTCCGTTTGGGGCGCACCATACGGAGGCGGCCACCGGGGAGTGGGATGAGGTGCAGTCGGGATTGAGAGCTGCGGATGCACCACCCCCAACCATGCGGGTGGCCGTCACCGCTGCCCGACCGCCGAGGGCGAAGCCCGCACCAAGGCGGAGGGCAGCGCAACCGTCCGACGCAAGCCCCGCAGCGCAAGTAGATTTGAGAACTTTGGGATATTCACAGCAGCAGCAGGAAAAGATCAAGCCCAAAGTGAGGTCGACAGTCGCGCAGCATCACGAAGCGCTGGTGGGTCATGGGTTTACACATGCCCACATCGTAGCCTTGTCGCAGCACCCTGCAGCCCTTGGCACGGTCGCCGTCAAGTACCAGGACATGATTGCGGCGTTGCCGGAAGCCACACATGAGGCGATCGTCGGTGTGGGGAAACAGTGGAGCGGAGCCCGAGCGCTTGAGGCCCTGTTGACGGTCGCGGGAGAGCTGAGAGGGCCTCCCCTTCAGCTGGACACGGGCCAGTTGCTGAAGATCGCGAAGCGGGGAGGAGTCACGGCGGTCGAGGCGGTGCACGCGTGGCGCAATGCGCTCACGGGAGCACCCCTCAACCTGACC[gagacg]GTACATGAAACGCATGGCACGG[cgtctc]AACTCACGCCTGAGCAGGTAGTGGCTATTGCATCC*AATATC*GGGGGCAGACCCGCACTGGAGTCAATCGTGGCCCAGCTTTCGAGGCCGGACCCCGCGCTGGCCGCACTCACTAATGATCATCTTGTAGCGCTGGCCTGCCTCGGCGGACGACCCGCCTTGGATGCGGTGAAGAAGGGGCTCCCGCACGCGCCTGCATTGATTAAGCGGACCAACAGAAGGATTCCCGAGAGGACATCACATCGAGTGGCAGATCACGCGCAAGTGGTCCGCGTGCTCGGATTCTTCCAGTGTCACTCCCACCCCGCACAAGCGTTCGATGACGCCATGACTCAATTTGGTATGTCGAGACACGGACTGCTGCAGCTCTTTCGTAGAGTCGGTGTCACAGAACTCGAGGCCCGCTCGGGCACACTGCCTCCCGCCTCCCAGCGGTGGGACAGGATTCTCCAAGCGAGCGGTATGAAACGC -continued

```
GCGAAGCCTTCACCTACGTCAACTCAGACACCTGACCAGGCGAGCCTTCATGCGTTCGCAGA
CTCGCTGGAGAGGGATTTGGACGCGCCCTCGCCCATGCATGAAGGGGACCAAACTCGCGCG
TCA
gctagccccaagaagaagagaaaggtggaggccagcggttccGGACGGGCTGACGCATTGGACGATTT
TGATCTGGATATGCTGGGAAGTGACGCCCTCGATGATTTTGACCTTGACATGCTTGGTTCGG
ATGCCCTTGATGACTTTGACCTCGACATGCTCGGCAGTGACGCCCTTGATGATTTCGACCTG
GACATGCTGATTAACtctagaggcagtggagagggcagaggaagtctgctaacatgcggtga
cgtcgaggagaatcctggcccaGTGAGCAAGGGCGAGGAGCTGTTCACCGGGGTGGTGCCCA
TCCTGGTCGAGCTGGACGGCGACGTAAACGGCCACAAGTTCAGCGTGTCCGGCGAGGGCGAG
GGCGATGCCACCTACGGCAAGCTGACCCTGAAGTTCATCTGCACCACCGGCAAGCTGCCCGT
GCCCTGGCCCACCCTCGTGACCACCCTGACCTACGGCGTGCAGTGCTTCAGCCGCTACCCCG
ACCACATGAAGCAGCACGACTTCTTCAAGTCCGCCATGCCCGAAGGCTACGTCCAGGAGCGC
ACCATCTTCTTCAAGGACGACGGCAACTACAAGACCCGCGCCGAGGTGAAGTTCGAGGGCGA
CACCCTGGTGAACCGCATCGAGCTGAAGGGCATCGACTTCAAGGAGGACGGCAACATCCTGG
GGCACAAGCTGGAGTACAACTACAACAGCCACAACGTCTATATCATGGCCGACAAGCAGAAG
AACGGCATCAAGGTGAACTTCAAGATCCGCCACAACATCGAGGACGGCAGCGTGCAGCTCGC
CGACCACTACCAGCAGAACACCCCCATCGGCGACGGCCCCGTGCTGCTGCCCGACAACCACT
ACCTGAGCACCCAGTCCGCCCTGAGCAAAGACCCCAACGAGAAGCGCGATCACATGGTCCTG
CTGGAGTTCGTGACCGCCGCCGGGATCACTCTCGGCATGGACGAGCTGTACAAGTAA
```

>dTALE-Backbone(NG in 0.5 repeat)-NLS-VP64-2A-EGFP

SEQ ID NO: 193

```
ATGTCGCGGACCCGGCTCCCTTCCCCACCCGCACCCAGCCCAGCGTTTTCGGCCGACTCGTTC
TCAGACCTGCTTAGGCAGTTCGACCCCTCACTGTTTAACACATCGTTGTTCGACTCCCTTCCT
CCGTTTGGGGCGCACCATACGGAGGCGGCCACCGGGGAGTGGGATGAGGTGCAGTCGGGAT
TGAGAGCTGCGGATGCACCACCCCCAACCATGCGGGTGGCCGTCACCGCTGCCCGACCGCC
GAGGGCGAAGCCCGCACCAAGGCGGAGGGCAGCGCAACCGTCCGACGCAAGCCCCGCAGC
GCAAGTAGATTTGAGAACTTTGGGATATTCACAGCAGCAGCAGGAAAAGATCAAGCCCAAA
GTGAGGTCGACAGTCGCGCAGCATCACGAAGCGCTGGTGGGTCATGGGTTTACACATGCCC
ACATCGTAGCCTTGTCGCAGCACCCTGCAGCCCTTGGCACGGTCGCCGTCAAGTACCAGGAC
ATGATTGCGGCGTTGCCGGAAGCCACACATGAGGCGATCGTCGGTGTGGGGAAACAGTGGA
GCGGAGCCCGAGCGCTTGAGGCCCTGTTGACGGTCGCGGGAGAGCTGAGAGGGCCTCCCCT
TCAGCTGGACACGGGCCAGTTGCTGAAGATCGCGAAGCGGGGAGGAGTCACGGCGGTCGAG
GCGGTGCACGCGTGGCGCAATGCGCTCACGGGAGCACCCCTCAACCTGACC[gagacg]GTACA
TGAAACGCATGGCACGG[cgtctc]AACTCACGCCTGAGCAGGTAGTGGCTATTGCATCC*AATG
GC*GGGGGCAGACCCGCACTGGAGTCAATCGTGGCCCAGCTTTCGAGGCCGGACCCCGCGC
TGGCCGCACTCACTAATGATCATCTTGTAGCGCTGGCCTGCCTCGGCGGACGACCCGCCTTG
GATGCGGTGAAGAAGGGGCTCCCGCACGCGCCTGCATTGATTAAGCGGACCAACAGAAGGA
TTCCCGAGAGGACATCACATCGAGTGGCAGATCACGCGCAAGTGGTCCGCGTGCTCGGATTC
TTCCAGTGTCACTCCCACCCCGCACAAGCGTTCGATGACGCCATGACTCAATTTGGTATGTC
GAGACACGGACTGCTGCAGCTCTTTCGTAGAGTCGGTGTCACAGAACTCGAGGCCCGCTCGG
GCACACTGCCTCCCGCCTCCCAGCGGTGGGACAGGATTCTCCAAGCGAGCGGTATGAAACG
CGCGAAGCCTTCACCTACGTCAACTCAGACACCTGACCAGGCGAGCCTTCATGCGTTCGCAG
ACTCGCTGGAGAGGGATTTGGACGCGCCCTCGCCCATGCATGAAGGGGACCAAACTCGCGC
GTCA
gctagccccaagaagaagagaaaggtggaggccagcggttccGGACGGGCTGACGCATTGGACGATT
TTGATCTGGATATGCTGGGAAGTGACGCCCTCGATGATTTTGACCTTGACATGCTTGGTTCGGATGC
CCTTGATGACTTTGACCTCGACATGCTCGGCAGTGACGCCCTTGATGATTTCGACCTGGACAT
GCTGATTAAC
tctagaggcagtggagagggcagaggaagtctgctaacatgcggtgacgtcgaggagaa
tcctggcccaGTGAGCAAGGGCGAGGAGCTGTTCACCGGGGTGGTGCCCATCCTGGTCGAGCTGGACGG
CGACGTAAACGGCCACAAGTTCAGCGTGTCCGGCGAGGGCGAGGGCGATGCCACCTACGGCAAGCTGAC
CCTGAAGTTCATCTGCACCACCGGCAAGCTGCCCGTGCCCTGGCCCACCCTCGTGACCACCCT
GACCTACGGCGTGCAGTGCTTCAGCCGCTACCCCGACCACATGAAGCAGCACGACTTCTTCA
AGTCCGCCATGCCCGAAGGCTACGTCCAGGAGCGCACCATCTTCTTCAAGGACGACGGCAA
CTACAAGACCCGCGCCGAGGTGAAGTTCGAGGGCGACACCCTGGTGAACCGCATCGAGCTG
AAGGGCATCGACTTCAAGGAGGACGGCAACATCCTGGGGCACAAGCTGGAGTACAACTACA
ACAGCCACAACGTCTATATCATGGCCGACAAGCAGAAGAACGGCATCAAGGTGAACTTCAA
GATCCGCCACAACATCGAGGACGGCAGCGTGCAGCTCGCCGACCACTACCAGCAGAACACC
CCCATCGGCGACGGCCCCGTGCTGCTGCCCGACAACCACTACCTGAGCACCCAGTCCGCCCT
GAGCAAAGACCCCAACGAGAAGCGCGATCACATGGTCCTGCTGGAGTTCGTGACCGCCGCC
GGGATCACTCTCGGCATGGACGAGCTGTACAAGTAA
```

>dTALE-Backbone(HD in 0.5 repeat)-NLS-VP64-2A-EGFP

SEQ ID NO: 194

```
ATGTCGCGGACCCGGCTCCCTTCCCCACCCGCACCCAGCCCAGCGTTTTCGGCCGACTCGTTC
TCAGACCTGCTTAGGCAGTTCGACCCCTCACTGTTTAACACATCGTTGTTCGACTCCCTTCCT
CCGTTTGGGGCGCACCATACGGAGGCGGCCACCGGGGAGTGGGATGAGGTGCAGTCGGGAT
TGAGAGCTGCGGATGCACCACCCCCAACCATGCGGGTGGCCGTCACCGCTGCCCGACCGCC
GAGGGCGAAGCCCGCACCAAGGCGGAGGGCAGCGCAACCGTCCGACGCAAGCCCCGCAGC
GCAAGTAGATTTGAGAACTTTGGGATATTCACAGCAGCAGCAGGAAAAGATCAAGCCCAAA
GTGAGGTCGACAGTCGCGCAGCATCACGAAGCGCTGGTGGGTCATGGGTTTACACATGCCC
ACATCGTAGCCTTGTCGCAGCACCCTGCAGCCCTTGGCACGGTCGCCGTCAAGTACCAGGAC
ATGATTGCGGCGTTGCCGGAAGCCACACATGAGGCGATCGTCGGTGTGGGGAAACAGTGGA
GCGGAGCCCGAGCGCTTGAGGCCCTGTTGACGGTCGCGGGAGAGCTGAGAGGGCCTCCCCT
TCAGCTGGACACGGGCCAGTTGCTGAAGATCGCGAAGCGGGGAGGAGTCACGGCGGTCGAG
GCGGTGCACGCGTGGCGCAATGCGCTCACGGGAGCACCCCTCAACCTGACC[gagacg]GTACA
TGAAACGCATGGCACGG[cgtctc]AACTCACGCCTGAGCAGGTAGTGGCTATTGCATCC*CATG
AC*GGGGGCAGACCCGCACTGGAGTCAATCGTGGCCCAGCTTTCGAGGCCGGACCCCGCGCT
GGCCGCACTCACTAATGATCATCTTGTAGCGCTGGCCTGCCTCGGCGGACGACCCGCCTTGG
ATGCGGTGAAGAAGGGGCTCCCGCACGCGCCTGCATTGATTAAGCGGACCAACAGAAGGAT
```

-continued

TCCCGAGAGGACATCACATCGAGTGGCAGATCACGCGCAAGTGGTCCGCGTGCTCGGATTCT
TCCAGTGTCACTCCCACCCCGCACAAGCGTTCGATGACGCCATGACTCAATTTGGTATGTCG
AGACACGGACTGCTGCAGCTCTTTCGTAGAGTCGGTGTCACAGAACTCGAGGCCCGCTCGGG
CACACTGCCTCCCGCCTCCCAGCGGTGGGACAGGATTCTCCAAGCGAGCGGTATGAAACGC
GCGAAGCCTTCACCTACGTCAACTCAGACACCTGACCAGGCGAGCCTTCATGCGTTCGCAGA
CTCGCTGGAGAGGGATTTGGACGCGCCCTCGCCCATGCATGAAGGGGACCAAACTCGCGCG
TCA
gctagccccaagaagaagagaaaggtggaggccagcggttccGGACGGGCTGACGCATTGGACGAT
TTTGATCTGGATATGCTGGGAAGTGACGCCCTCGATGATTTTGACCTTGACATGCTTGGTTCGGATGCC
CTTGATGACTTTGACCTCGACATGCTCGGCAGTGACGCCCTTGATGATTTCGACCTGGACAT
GCTGATTAAC
tctagaggcagtggagagggcagaggaagtctgctaacatgcggtgacgtcgaggagaa
tcctggcccaGTGAGCAAGGGCGAGGAGCTGTTCACCGGGGTGGTGCCCATCCTGGTCGAGCTGGACGG
CGACGTAAACGGCCACAAGTTCAGCGTGTCCGGCGAGGGCGAGGGCGATGCCACCTACGGCAAGCTGAC
CCTGAAGTTCATCTGCACCACCGGCAAGCTGCCCGTGCCCTGGCCCACCCTCGTGACCACCCT
GACCTACGGCGTGCAGTGCTTCAGCCGCTACCCCGACCACATGAAGCAGCACGACTTCTTCA
AGTCCGCCATGCCCGAAGGCTACGTCCAGGAGCGCACCATCTTCTTCAAGGACGACGGCAA
CTACAAGACCCGCGCCGAGGTGAAGTTCGAGGGCGACACCCTGGTGAACCGCATCGAGCTG
AAGGGCATCGACTTCAAGGAGGACGGCAACATCCTGGGGCACAAGCTGGAGTACAACTACA
ACAGCCACAACGTCTATATCATGGCCGACAAGCAGAAGAACGGCATCAAGGTGAACTTCAA
GATCCGCCACAACATCGAGGACGGCAGCGTGCAGCTCGCCGACCACTACCAGCAGAACACC
CCCATCGGCGACGGCCCCGTGCTGCTGCCCGACAACCACTACCTGAGCACCCAGTCCGCCCT
GAGCAAAGACCCCAACGAGAAGCGCGATCACATGGTCCTGCTGGAGTTCGTGACCGCCGCC
GGGATCACTCTCGGCATGGACGAGCTGTACAAGTAA >dTALE-Backbone(NN in 0.5 repeat)-NLS-VP64-2A-EGFP

SEQ ID NO: 195

ATGTCGCGGACCCGGCTCCCTTCCCCACCCGCACCCAGCCCAGCGTTTTCGGCCGACTCGTTC
TCAGACCTGCTTAGGCAGTTCGACCCCTCACTGTTTAACACATCGTTGTTCGACTCCCTTCCT
CCGTTTGGGGCGCACCATACGGAGGCGGCCACCGGGGAGTGGGATGAGGTGCAGTCGGGAT
TGAGAGCTGCGGATGCACCACCCCCAACCATGCGGGTGGCCGTCACCGCTGCCCGACCGCC
GAGGGCGAAGCCCGCACCAAGGCGGAGGGCAGCGCAACCGTCCGACGCAAGCCCCGCAGC
GCAAGTAGATTTGAGAACTTTGGGATATTCACAGCAGCAGCAGGAAAAGATCAAGCCCAAA
GTGAGGTCGACAGTCGCGCAGCATCACGAAGCGCTGGTGGGTCATGGGTTTACACATGCCC
ACATCGTAGCCTTGTCGCAGCACCCTGCAGCCCTTGGCACGGTCGCCGTCAAGTACCAGGAC
ATGATTGCGGCGTTGCCGGAAGCCACACATGAGGCGATCGTCGGTGTGGGGAAACAGTGGA
GCGGAGCCCGAGCGCTTGAGGCCCTGTTGACGGTCGCGGGAGAGCTGAGAGGGCCTCCCCT
TCAGCTGGACACGGGCCAGTTGCTGAAGATCGCGAAGCGGGGAGGAGTCACGGCGGTCGAG
GCGGTGCACGCGTGGCGCAATGCGCTCACGGGAGCACCCCTCAACCTGACC[gagacg]GTACA
TGAAACGCATGGCACGG[cgtctc]AACTCACGCCTGAGCAGGTAGTGGCTATTGCATCC***AATA
AC***GGGGGCAGACCCGCACTGGAGTCAATCGTGGCCCAGCTTTCGAGGCCGGACCCCGCGCT
GGCCGCACTCACTAATGATCATCTTGTAGCGCTGGCCTGCCTCGGCGGACGACCCGCCTTGG
ATGCGGTGAAGAAGGGGCTCCCGCACGCGCCTGCATTGATTAAGCGGACCAACAGAAGGAT
TCCCGAGAGGACATCACATCGAGTGGCAGATCACGCGCAAGTGGTCCGCGTGCTCGGATTCT
TCCAGTGTCACTCCCACCCCGCACAAGCGTTCGATGACGCCATGACTCAATTTGGTATGTCG
AGACACGGACTGCTGCAGCTCTTTCGTAGAGTCGGTGTCACAGAACTCGAGGCCCGCTCGGG
CACACTGCCTCCCGCCTCCCAGCGGTGGGACAGGATTCTCCAAGCGAGCGGTATGAAACGC
GCGAAGCCTTCACCTACGTCAACTCAGACACCTGACCAGGCGAGCCTTCATGCGTTCGCAGA
CTCGCTGGAGAGGGATTTGGACGCGCCCTCGCCCATGCATGAAGGGGACCAAACTCGCGCG
TCA
gctagccccaagaagaagagaaaggtggaggccagcggttccGGACGGGCTGACGCATTGGACGAT
TTTGATCTGGATATGCTGGGAAGTGACGCCCTCGATGATTTTGACCTTGACATGCTTGGTTCGGATGCC
CTTGATGACTTTGACCTCGACATGCTCGGCAGTGACGCCCTTGATGATTTCGACCTGGACAT
GCTGATTAAC
tctagaggcagtggagagggcagaggaagtctgctaacatgcggtgacgtcgaggagaa
tcctggcccaGTGAGCAAGGGCGAGGAGCTGTTCACCGGGGTGGTGCCCATCCTGGTCGAGCTGGACGG
CGACGTAAACGGCCACAAGTTCAGCGTGTCCGGCGAGGGCGAGGGCGATGCCACCTACGGCAAGCTGAC
CCTGAAGTTCATCTGCACCACCGGCAAGCTGCCCGTGCCCTGGCCCACCCTCGTGACCACCCT
GACCTACGGCGTGCAGTGCTTCAGCCGCTACCCCGACCACATGAAGCAGCACGACTTCTTCA
AGTCCGCCATGCCCGAAGGCTACGTCCAGGAGCGCACCATCTTCTTCAAGGACGACGGCAA
CTACAAGACCCGCGCCGAGGTGAAGTTCGAGGGCGACACCCTGGTGAACCGCATCGAGCTG
AAGGGCATCGACTTCAAGGAGGACGGCAACATCCTGGGGCACAAGCTGGAGTACAACTACA
ACAGCCACAACGTCTATATCATGGCCGACAAGCAGAAGAACGGCATCAAGGTGAACTTCAA
GATCCGCCACAACATCGAGGACGGCAGCGTGCAGCTCGCCGACCACTACCAGCAGAACACC
CCCATCGGCGACGGCCCCGTGCTGCTGCCCGACAACCACTACCTGAGCACCCAGTCCGCCCT
GAGCAAAGACCCCAACGAGAAGCGCGATCACATGGTCCTGCTGGAGTTCGTGACCGCCGCC
GGGATCACTCTCGGCATGGACGAGCTGTACAAGTAA

TABLE 3

List of repeat monomer sequences (amino acid and nucleic acid). Forward and reverse priming sites are bolded and underlined.

NI L T P E Q V V A I A S N I G G K Q A L
CTGACCCCAGAGCAGGTCGTGGCAATCGCCTCCAACATTGGCGGGAAACAGGCACTC
E T V Q R L L P V L C Q A H G (SEQ ID NO: 196)
GAGACTGTCCAGCGCCTGCTTCCCGTGCTGTGCCAAGCGCACGGA (SEQ ID NO: 197)

TABLE 3-continued

List of repeat monomer sequences (amino acid and nucleic acid). Forward and reverse priming sites are bolded and underlined.

```
HD L  T  P  E  Q  V  V  A  I  A  S  H  D  G  G  K  Q  A  L
   TTGACCCCAGAGCAGGTCGTGGCGATCGCAAGCCACGACGGAGGAAAGCAAGCCTTG
   E  T  V  Q  R  L  L  P  V  L  C  Q  A  H  G (SEQ ID NO: 198)
   GAAACAGTACAGAGGCTGTTGCCTGTGCTGTGCCAAGCGCACGGG (SEQ ID NO: 199)

NN L  T  P  E  Q  V  V  A  I  A  S  N  N  G  G  K  Q  A  L
   CTTACCCCAGAGCAGGTCGTGGCAATCGCGAGCAATAACGGCGGAAAACAGGCTTTG
   E  T  V  Q  R  L  L  P  V  L  C  Q  A  H  G (SEQ ID NO: 200)
   GAAACGGTGCAGAGGCTCCTTCCAGTGCTGTGCCAAGCGCACGGG (SEQ ID NO: 201)

NG L  T  P  E  Q  V  V  A  I  A  S  N  G  G  G  K  Q  A  L
   CTGACCCCAGAGCAGGTCGTGGCCATTGCCTCGAATGGAGGGGGCAAACAGGCGTTG
   E  T  V  Q  R  L  L  P  V  L  C  Q  A  H  G (SEQ ID NO: 202)
   GAAACCGTACAACGATTGCTGCCGGTGCTGTGCCAAGCGCACGGC (SEQ ID NO: 203)
```

TABLE 4

Primers used for the amplification and assembly of engineered designer TALE polypeptides described in Example 1 are shown. Unique linkers used to specify the ligation ordering are highlighted in bold; sequences written from 5' to 3' BsmBI sites are single-underlined and BsaI sites are double-underlined.

| | |
|---|---|
| F1 | AGATGCCGTCCTAGCGcgtctcCTGACCCCAGAGCAGGTCGTGG (SEQ ID NO: 204) |
| F2 | AGATGCCGTCCTAGCGcgtctcGACTCACCCCAGAGCAGGTCGTG (SEQ ID NO: 205) |
| F3 | AGATGCCGTCCTAGCGcgtctcGCCTCACCCCAGAGCAGGTCGTG (SEQ ID NO: 206) |
| F4 | AGATGCCGTCCTAGCGcgtctcGATTAACCCCAGAGCAGGTCGTG (SEQ ID NO: 207) |
| F5 | AGATGCCGTCCTAGCGcgtctcGCTTAACCCCAGAGCAGGTCGTG (SEQ ID NO: 208) |
| F6 | AGATGCCGTCCTAGCGcgtctcGACTTACCCCAGAGCAGGTCGTG (SEQ ID NO: 209) |
| F7 | AGATGCCGTCCTAGCGcgtctcGCCTTACCCCAGAGCAGGTCGTG (SEQ ID NO: 210) |
| F8 | AGATGCCGTCCTAGCGcgtctcGACTAACCCCAGAGCAGGTCGTG (SEQ ID NO: 211) |
| F9 | AGATGCCGTCCTAGCGcgtctcGGCTCACCCCAGAGCAGGTCGTG (SEQ ID NO: 212) |
| F10 | AGATGCCGTCCTAGCGcgtctcGGCTAACCCCAGAGCAGGTCGTG (SEQ ID NO: 213) |
| F11 | AGATGCCGTCCTAGCGcgtctcGCCTAACCCCAGAGCAGGTCGTG (SEQ ID NO: 214) |
| F12 | AGATGCCGTCCTAGCGcgtctcGGTTAACCCCAGAGCAGGTCGTG (SEQ ID NO: 215) |
| R1 | GTATCTTTCCTGTGCCCAggtctcTGAGTCCGTGCGCTTGGCAC (SEQ ID NO: 216) |
| R2 | GTATCTTTCCTGTGCCCAggtctcTGAGGCCGTGCGCTTGGCAC (SEQ ID NO: 217) |
| R3 | GTATCTTTCCTGTGCCCAggtctcTTAATCCGTGCGCTTGGCAC (SEQ ID NO: 218) |
| R4 | GTATCTTTCCTGTGCCCAggtctcTTAAGCCGTGCGCTTGGCAC (SEQ ID NO: 219) |
| R5 | GTATCTTTCCTGTGCCCAggtctcTAAGTCCGTGCGCTTGGCAC (SEQ ID NO: 220) |
| R6 | GTATCTTTCCTGTGCCCAggtctcTAAGGCCGTGCGCTTGGCAC (SEQ ID NO: 221) |
| R7 | GTATCTTTCCTGTGCCCAggtctcTTAGTCCGTGCGCTTGGCAC (SEQ ID NO: 222) |
| R8 | GTATCTTTCCTGTGCCCAggtctcTGAGCCCGTGCGCTTGGCAC (SEQ ID NO: 223) |
| R9 | GTATCTTTCCTGTGCCCAggtctcTTAGCCCGTGCGCTTGGCAC (SEQ ID NO: 224) |
| R10 | GTATCTTTCCTGTGCCCAggtctcTTAGGCCGTGCGCTTGGCAC (SEQ ID NO: 225) |

TABLE 4-continued

| Primers used for the amplification and assembly of engineered designer TALE polypeptides described in Example 1 are shown. Unique linkers used to specify the ligation ordering are highlighted in bold; sequences written from 5' to 3' BsmBI sites are single-underlined and BsaI sites are double-underlined. | |
|---|---|
| R11 | GTATCTTTCCTGTGCCCAggtctcTTAACCCGTGCGCTTGGCAC (SEQ ID NO: 226) |
| R12 | GTATCTTTCCTGTGCCCAggtctcTTAAACCGTGCGCTTGGCAC (SEQ ID NO: 227) |
| F-assem | ATATAGATGCCGTCCTAGCGC (SEQ ID NO: 228) |
| R-assem | AAGTATCTTTCCTGTGCCCAG (SEQ ID NO: 229) |

TABLE 5

| Primers used in the simplified step-by-step dTALE construction method described in Example 2. Unique linkers used to specify the ligation ordering are highlighted in bold; sequences written from 5' to 3'. BsmBI sites are single-underlined and BsaI sites are double-underlined. | |
|---|---|
| F1 | ATATAGATGCCGTCCTAGCGcgtctcCTGACCCCAGAGCAGGTCGTGG (SEQ ID NO: 230) |
| F2 | TGCTCTTTATTCGTTGCGTCggtctcG**ACTC**ACCCCAGAGCAGGTCGTG (SEQ ID NO: 231) |
| F3 | TGCTCTTTATTCGTTGCGTCggtctcG**CCTC**ACCCCAGAGCAGGTCGTG (SEQ ID NO: 232) |
| F4 | TGCTCTTTATTCGTTGCGTCggtctcG**ATTA**ACCCCAGAGCAGGTCGTG (SEQ ID NO: 233) |
| F5 | ATATAGATGCCGTCCTAGCGcgtctcG**CTTA**ACCCCAGAGCAGGTCGTG (SEQ ID NO: 234) |
| F6 | TGCTCTTTATTCGTTGCGTCggtctcG**ACTC**ACCCCAGAGCAGGTCGTG (SEQ ID NO: 235) |
| F7 | TGCTCTTTATTCGTTGCGTCggtctcG**CCTC**ACCCCAGAGCAGGTCGTG (SEQ ID NO: 236) |
| F8 | TGCTCTTTATTCGTTGCGTCggtctcG**ATTA**ACCCCAGAGCAGGTCGTG (SEQ ID NO: 237) |
| F9 | ATATAGATGCCGTCCTAGCGcgtctcG**GCTC**ACCCCAGAGCAGGTCGTG (SEQ ID NO: 238) |
| F10 | TGCTCTTTATTCGTTGCGTCggtctcG**ACTC**ACCCCAGAGCAGGTCGTG (SEQ ID NO: 239) |
| F11 | TGCTCTTTATTCGTTGCGTCggtctcG**CCTC**ACCCCAGAGCAGGTCGTG (SEQ ID NO: 240) |
| F12 | TGCTCTTTATTCGTTGCGTCggtctcG**ATTA**ACCCCAGAGCAGGTCGTG (SEQ ID NO: 241) |
| R1 | TCTTATCGGTGCTTCGTTCTggtctc**TGAGT**CCGTGCGCTTGGCAC (SEQ ID NO: 242) |
| R2 | TCTTATCGGTGCTTCGTTCTggtctc**TGAGG**CCGTGCGCTTGGCAC (SEQ ID NO: 243) |
| R3 | TCTTATCGGTGCTTCGTTCTggtctc**TTAAT**CCGTGCGCTTGGCAC (SEQ ID NO: 244) |
| R4 | AAGTATCTTTCCTGTGCCCAcgtctc**TTAAG**CCGTGCGCTTGGCAC (SEQ ID NO: 245) |
| R5 | TCTTATCGGTGCTTCGTTCTggtctc**TGAGT**CCGTGCGCTTGGCAC (SEQ ID NO: 246) |
| R6 | TCTTATCGGTGCTTCGTTCTggtctc**TGAGG**CCGTGCGCTTGGCAC (SEQ ID NO: 247) |
| R7 | TCTTATCGGTGCTTCGTTCTggtctc**TTAAT**CCGTGCGCTTGGCAC (SEQ ID NO: 248) |
| R8 | AAGTATCTTTCCTGTGCCCAcgtctc**TGAGC**CCGTGCGCTTGGCAC (SEQ ID NO: 249) |
| R9 | TCTTATCGGTGCTTCGTTCTggtctc**TGAGT**CCGTGCGCTTGGCAC (SEQ ID NO: 250) |
| R10 | TCTTATCGGTGCTTCGTTCTggtctc**TGAGG**CCGTGCGCTTGGCAC (SEQ ID NO: 251) |
| R11 | TCTTATCGGTGCTTCGTTCTggtctc**TTAAT**CCGTGCGCTTGGCAC (SEQ ID NO: 252) |
| R12 | AAGTATCTTTCCTGTGCCCAcgtctc**TGAGT**CCGTGCGCTTGGCAC (SEQ ID NO: 253) |
| F-assem | ATATAGATGCCGTCCTAGCG (SEQ ID NO: 254) |
| R-assem | AAGTATCTTTCCTGTGCCCA (SEQ ID NO: 255) |

EQUIVALENTS

Those skilled in the art will recognize, or be able to ascertain using no more than routine experimentation, many equivalents of the specific embodiments of the subject matter described herein. Such equivalents are intended to be encompassed by the following claims.

SEQUENCE LISTING (315 sequences)

SEQ ID NO: 1 - protein, 34 aa, Artificial Sequence
  Description of Artificial Sequence: Synthetic exemplary consensus sequence
LTPEQVVAIASNGGGKQALETVQRLLPVLCQAHG

SEQ ID NO: 2 - protein, 35 aa, Artificial Sequence
  Description of Artificial Sequence: Synthetic exemplary consensus sequence
LTPEQVVAIASNGGGKQALETVQRLLPVLCQAPHD

SEQ ID NO: 3 - protein, 11 aa, Human immunodeficiency virus
YGRKKRRQRRR

SEQ ID NO: 4 - protein, 494 aa, Xanthomonas campestris
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPDQVVAIASNGGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNGGGKQALETVQRLLPVLCQAHGLI

SEQ ID NO: 5 - protein, 1160 aa, Xanthomonas vesicatoria
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPDQVVAIASNGGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASNGGGKQALETVQRLLPVLCQAHGLIPQQVVAIASNIGGKQALETVQRLLPVLCQDHGLTPQQVVAIASNSGGKQALETVQRLLPVLCQAHGLTPEQVVAIASNGGGKQALETVQRLLPVLCQAHGLTPQQVVAIASNIGGKQALETVQRLLPVLCQDHGLTPQQVVAIASNSGGKQALETVQRLLPVLCQAHGLTPQQVVAIASNGGGKQALETVQRLLPVLCQAHGLTPQQVVAIASHDGGKQALETVQRLLPVLCQAHGLTPQQVVAIASHDGGKQALETVQRLLPVLCQAHGLTPQQVVAIASNSGGKQALETVQRLLPVLCQAHGLTPQQVVAIASHDGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGGTPTAADLAASSTVMREQDEDPFAGAADDFPAFNEEELAWLMELLPQ

SEQ ID NO: 6 - protein, 1163 aa, Xanthomonas citri
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLCQAHGLTPEQVVAIASNGGGKQALETVQRLLPVLCQAHGLTPDQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNSGGKQALETVQRLLPVLCQAHGLTPDQVVAIASHDGGKQALETVQRLLPVLCQAHGLTPEQVVAIASHDGGKQALETVQRLLPVLCQAHGLTPEQVVAIACNGGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPTAADLAASSTVMREQDEDPFAGAADDFPAFNEEELAWLMELLPQ

SEQ ID NO: 7 - protein, 1102 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVEAVHAWRNALTGAPLNLTPDQVVAIASNIGGNQALETVQRLLPVLCQAHGLTPDQVVAIASHGGGKQALETVQRLLPVLCQAHGLTPDQVVAIASNIGGKQALATVQRLLPVLCQDHGLTPDQVVAIASHGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNNGGKQALETVQRLLPVLCQTHGLTPDQVVAIANHDGGKQALETVQRLLPVLCQDHGLTPDQVVAIASNIGGKQALATVQRLLPVLCQAHGLTPDQVVAIASHDGGKQALETVQRLLPVLCQDHGLTPDQVVAIASNNGGKQALETVQRLLPVLCQDHGLTPAQVVAIANHGGGKQALETVQRLLPVLCQDHGLTPVQVVAIASNSGGKQALETVQRLLPVLCQDHGLTPVQVVAIASNGGGKQALATVQRLLPVLCQDHGLTPVQVVAIASHDGGKQALETVQRLLPVLCQDHGLTPDQVVAIASNGGKQALESIVAQLSRPDPALAALTNDHLVALACLGGRPALDAVKKGLPHAPELIRRINRRIPERTSHRVADLAHVVRVLGFFQSHSHPAQAFDDAMTQFGMSRHGLAQLFRRVGVTELEARYGTLPPASQRWDRILQASGMKRVKPSPTSAQTPDQASLHAFADSLERDLDAPSPMHEGDQTRASSRKRSRSDRAVTGPSTQQSFEVRVPEQQDALHLPLSWRVKRPRTRIGGGLPDPGTPIAADLAASSTVMWEQDAAPFAGAADDFPAFNEEELAWLMELLPQSGSVGGTI

SEQ ID NO: 8 - protein, 1028 aa, Xanthomonas citri
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNIGGKQALETVQALLPVLCQAHGLTPEQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLPPEQVVAIASHDGGKQALETVQRLLPVLCQAHGLTLDQVVAIASNIGGKQALETVQRLLPVLCQAHGLTPQQVVAIASNSGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPAQVVAIASNNGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLVQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 9 - protein, 1164 aa, Xanthomonas euvesicatoria
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNSGGKQALETVQRLLPVLCQAHGLTPEQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNSGGKQALETVQALLPVLCQAHGLTPEQVVAIASNSGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGRPALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 10 - protein, 1026 aa, Xanthomonas campestris
MDPIRSRTPSPARELLPGPQPDGVEPTADRGVSPPVGGPLDGLPARRTMSRTRLPSPPAPLPAFSAGSFSDLLRQFDPSLFNTSLFDSMPAVGTPHTEAAPAEWDEVQSALRAADDPPPTVRVAVTAARPPRAKPAPRRRAQPSDASPAAQVDLRTLGYSQQQQEKIKPKARSTVAQHHEALVGHGFTHAHIVALSQHPAALGTVAVTYQDMIAALPEATHEDIVGVGKQWSGARALEALLTVAGDLRGPPLQLDTGQLLKIAKRGGVTAVEAVHAWRNALTDAPLNLTPDQVVAIASNIGGKQALETVQRLLPVLCQAHGLTPEQVVAIASHDGGKQALETVQRLLPVLCQAHGLTPDQVVAIASHDGGKQALETVQRLLPVLCQAHGLTPEQVVAIASNIGGKQALETVQRLLPVLCQAHGLTPDQVVAIASHDGGKQALETVQRLLPVLCQAHGLTPEQVVAIASNIGGKQALETVQRLLPVLCQAHGLTPQQVVAIASNGGGKQALETVQRLLPVLCEQHGLTPDQVVAIASNIGGKQALETVQRLLPVLCEQHGLTPEQVVAIASNNGGKQALETVQRLLPVLCQAHGLTPDQVVAIASHDGGKQALETVQRLLPVLCQAHGLTPDQVVAIASNIGGKQALETVQRLLPVLCQAHGLTPDQVVAIASNGGGRQALETVQRLLPVLCEQHGLTPDQVVAIASNGGKQALETVQRLLPVLCEQHGLTPAQVVAIASNNGGKQALESIFAQLSRPDPAFAALTNDHLVALACLGGRPALDAVKKGLPHAPTLIKRTNRRIPERTSHRVADHAHVARVLGFFQCHSHPAQAFDDAMTQFGMSRHGLVQLFRRVGVTELEARSGTLPPASQRWDRILHASGMKRAKPSPTSAQTPDQASLHAFADSLERDLDAPSPTHEGDQRRASSRKRSRSDRAVTGPSAQQAVEVRVPEQRDALHLPLSWSVKRPRTRIGGGLPDPGTPLEADLAASSTVMWGQDADPFAGAADDFPAFNEEELAWLRELLPQ

SEQ ID NO: 11 - protein, 1163 aa, Xanthomonas citri
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNSGGKQALETVQRLLPVLCQAHGLTPDQVVAIASHDGGKQALETVQRLLPVLCQAHGLTPEQVVAIASHDGGKQALETVQRLLPVLCQAHGLTPEQVVAIACNGGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPTAADLAASSTVMREQDEDPFAGAADDFPAFNEEELAWLMELLPQ

SEQ ID NO: 12 - protein, 1095 aa, Xanthomonas citri
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPDQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPTAADLAASSTVMREQDEDPFAGAADDFPAFNEEELAWLMELLPQ

SEQ ID NO: 13 - protein, 1367 aa, Xanthomonas citri
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPDQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPDQVVAIASHDGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIACNGGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRAPEQRDALHLPLSWRVKRPRTSIGGGLPDPGTPTAADLAASSTVMREQDEDPFAGAADDFPAFNEEELAWLMELLPQ

SEQ ID NO: 14 - protein, 1446 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTEARELRGPPLQLDTGQLLKIAKRGGVTAVEAVHAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIANNNGGKQALETLQRLLPVLCQDHGLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNSGGKQALETVQRLLPVLCQDHGLTPDQVVAIASNGGKQALETVQRLLPVLCQDHGLTPDQVVAIASNGGKQALETVQRLLPVQRLLPVLCQDHGLTQDQVVAIASHDGGKQALETVQRLLPVLCQDHGLTPDQVVAIASHDGGKQALETVQRLLPVLCQDHGLTPDQVVAIASNSGGKQALETVQRLLPVLCQDHGLTPDQVVAIASNSGGKQALETVQRLLPVLCQDHGLTPDQVVAIASNNGGKQALETVQRLLPVLCQDHGLTPDQVVAIANNNGGKQALETVQRLLPVLCQDHGLTPAQVVAIASNIGGKQALETVQRLLPVLCQDHGLTLDQVVAIASNGGSKQALETVQRLLPVLCQDHGLTPDQVVAIANNNGGKQALETVQRLLPVLCQDHGLTPDQVVAIASNIGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTELEARGGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 15 - protein, 1039 aa, Xanthomonas oryzae
HAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIANNNGGKQALETLQRLLPVLCQDHGLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNSGGKQALETVQRLLPVLCQDHGLTPDQVVAIASNGGKQALETVQRLLPVLCQDHGLTPDQVVAIASNGGKQALETVQRLLPVQRLLPVLCQDHGLTQDQVVAIASHDGGKQALETVQRLLPVLCQDHGLTPDQVVAIASHDGGKQALETVQRLLPVLCQDHGLTPDQVVAIASNSGGKQALETVQRLLPVLCQDHGLTPDQVVAIASNNGGKQALETVQRLLPVLFQEHGLTPDQVVAIASNSGGKQALETVQRLLPVLCQDHGLTPDQVVAIANNNGGKQALETVQRLLPVLCQDHGLTPAQVVAIASNIGGKQALETVQRLLPVLCQDHGLTLDQVVAIASNGGSKQALETVQRLLPVLCQDHGLTPDQVVAIANNNGGKQALETVQRLLPVLCQDHGLTPDQVVAIASNIGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGSPALDAVKKGLPHAPELIRRINRRIPERTSHRVPDLAHVVRVLGFFQSHSHPAQAFDDAMKQFEMSRHGLVQLFRRVGVTEFEARYGTLPPASQRWDRILQASGMKRAKPSPTSAQTPDQASLHA

SEQ ID NO: 16 - protein, 1245 aa, Ralstonia solanacearum
MRIGKSSGWLNESVSLEYEHVSPPTRPRDTRRRPRAAGDGGLAHLHRRLAVGYAEDTPRTEARSPAPRRPLPVAPASAPPAPSLVPEPPMPVSLPAVSSPRFSAGSSAAITDPFPSLPPTPVLYAMARELEALSDATWQPAVPLPAEPPTDARRGNTVFDEASASSPVIASACPQAFASPPRAPRSARARRARTGGDAWPAPTFLSRPSSSRIGRDVFGKLVALGYSREQIRKLKQESLSEIAKYHTTLTGQGFTHADICRISRRRQSLRVVARNYPELAAALPELTRAHIVDIARQRSGDLALQALLPVATALTAAPLRLSASQIATVAQYGERPAIQALYRLRRKLTRAPLHLTPQQVVAIASNTGGKRALEAVCVQLPVLRAAPYRLSTEQVVAIASNKGGKQALEAVKAHLLDLLGAPYVLDTEQVVAIASHNGGKQALEAVKADLLDLRGAPYALSTEQVVAIASHNGGKQALEAVKADLLELRGAPYALSTEQVVAIASHNGGKQALEAVKAHLLDLRGVPYALSTEQVVAIASHNGGKQALEAVKAQLLDLRGAPYALSTAQVVAIASNGGGKQALEGIGEQLLKLRTAPYGLSTEQVVAIASHDGGKQALEAVGAQLVALRAAPYALSTEQVVAIASNKGGKQALEAVKAQLLELRGAPYALSTAQVVAIASHDGGNQALEAVGTQLVALRAAPYALSTEQVVAIASHDGGKQALEAVGAQLVALRAAPYALNTEQVVAIASSHGGKQALEAVRALFPDLRAAPYALSTAQLVAIASNPGGKQALEAVRALFRELRAAPYALSTEQVVAIASNHGGKQALEAVRALFRGLRAAPYGLSTAQVVAIASSNGGKQALEAVWALLPVLRATPYDLNTAQIVAIASHDGGKPALEAVWAKLPVLRGAPYALSTAQVVAIACISGQQALEAIEAHMPTLRQASHSLSPERVAAIACIGGRSAVEAVRQGLPVKAIRRIRREKAPVAGPPPASLGPTPQELVAVLHFFRAHQQPRQAFVDALAAFQATRPALLRLLSSVGVTEIEALGGTIPDATERWQRLLGRLGFRPATGAAAPSPDSLQGFAQSLERTLGSPGMAGQSACSPHRKRPAETAIAPRSIRRSPNNAGQPSEPWPDQLAWLQRRKRTARSHIRADSAASVPANLHLGTRAQFTPDRLRAEPGPIMQAHTSPASVSFGSHVAFEPGLPDPGTPTSADLASFEAEPFGVGPLDFHLDWLLQILET

SEQ ID NO: 17 - protein, 1126 aa, Xanthomonas axonopodis
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVYAWRNALTGAPLNLTPEQVVAIASNIGGKQALETVQRLLPVLCQAHGLTPDQVVAIASNGGKQALETVQRLLPVLCQAHGLTPAQVVAIASNIGGKQALETVQRLLPVLCQAHGLTPAQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 18 - protein, 1096 aa, Xanthomonas axonopodis
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPDQVVAIASHDGGKQALETVQRLLPVLCQAHGLTPDQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 19 - protein, 1096 aa, Xanthomonas axonopodis
MDPIRSRTPSPARELLPGPQPDGVQPTADRGVSPPAGGPLDGLPARRTISRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPDQVVAIASNGGGKQALETVQRLLPVLCQAHGLTPDQVVAIASNIGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 20 - protein, 1163 aa, Xanthomonas axonopodis
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLCQAHGLTPEQVVAIASHDGGKQALETVQRLLPVLCQAHGLTPDQVVAIASHDGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNSGGKQALETVQRLLPVLCQAHGLTPDQVVAIASHDGGKQALETVQRLLPVLCQAHGLTPEQVVAIASHDGGKQALETVQRLLPVLCQAHGLTPEQVVAIACNGGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 21 - protein, 889 aa, Xanthomonas oryzae
MRPGKLCRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEAQSGLRAADDPPPTVRVAVTAARPPRAKPAPRRRAAQPSDASPAAQVDLRTLGYSQQQQEKIKPKVRSTVARHHEALVGHGFTHAHIVALSQHPAALGTVAVTYQDIIRALPEATHEDIVGVGKQWSGARALEALLTEAGELRGPPLQLDTGQLLKIAKRGGVTAVKAVHAWRNALTGAPLNLTPAQVVAIASHDGGNQALETVQRLLPVLCQDHGLTPAQVVAIASHDGGKQALETVQRLLPVLCQDHGLTPDQVVAIASHDGGKQALETVQRLLPVLCQDHGLTPAQAVAIASNGGGKQALETVQRLLPVLCQDHGLTPDQVVAIASNGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALESIVAQLSRPDPALAALTNDHLVALACLGGRPALDAVKKGLPHAPELIRRVNRRIGERTSHRVADYAQVVRVLEFFQCHSHPAQAFDDAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 22 - protein, 705 aa, Xanthomonas oryzae
MDPIRSRTPSPAREPLPGPQPDRVQPTADRGVSAPAGSPLDGLPARRTVSRTRLPSPPAPLPAFSAGSSTDRLRQFDPSLPDTSLFDSMPAVGTPHTEAAPADTSPAAQVDLLTLATVAQHHEALVGHGFTHAHIVALSQHPAALGTVAVTYQDIITALPEATHEDIVGVGKQLSGARALEALLTKAGELRGPPLQLDTGQLLKIARRGGVTAVEAVHAWRNALTGAPLNLTPDQVVAIASNSGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGKQALESIVAQLSRPDPALAALTNDHLVALACLGGRPALDAVKKGLPHAPELIRRVNSRIGERTSHRVADLAHVVRVLGFFQSHSHPAQAFDDAMTQFGMSRHGLVQLFRRVGVTEFEARCGTIPPASQRWDRILQASGTKRAKPSPTSAQTPDQASLHAFPDSLERDLDAPSPMHEGDQTRASRRKRSRSDRAVTDPSAQQSFEVRVPEQHDALHLPLSWRVKRPRTRIGGGLPDPGTPMVADLAASSTVMWEQDAAPFAGAADDFPAFNEEELAWLMELLPQSGSVGGTI

SEQ ID NO: 23 - protein, 1168 aa, Xanthomonas citri
MDPIRPRTSSPAHELLAGPQPDRVQPQPTADRGGAPPAGSPLDGLPARRTMSRTRLPSPPAPLPAFSAGSFSDLLCQFDPLLLDTLLFDSMSAFGAPHTEAAPGEADEVQSGLRAVDDPHPTVHVAVTAARPPRAKPAPRRRAAHTSDASPAGQVDLCTLGYSQQQQDEIKPKARATVAQHHQALMGHGFTRAHIVALSQHPAALGTVAVKYQAMIAALPEATHEDIVGVGKQWSGARALEALLTVSGELRGPPLQLDTGQLLKIAKRGGVTAVEAVHAWRNALTGAPLNLTPDQVVAIASHDGGKQALETVQRLLPVLCEQHGLTPAQVVAIASNGGGKQALETVQQLLPVLCEQHGLTPDQVVAIASHDGGKQALETVQRLLPVLCEQHGLTPAQVVAIASNGGGKQALETVQQLLPVLCEQHGLTPDQVVAIASNIGGKQALETVQRLLPVLCEQHGLTPAQVVAIASNGGGKQALETVQQLLPVLCEQHGLTPDQVVAIASHDGGKQALETVQRLLPVLCEQHGLTPAQVVAIASNGGGKQALKTVQQLLPVLCEQHGLTPDQVVAIASHDGGKQALETVQRLLPVLCEQHGLTPDQVVAIASNIGGKQALETVQRLLPVLCEQHGLTPDQVVAIASNIGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASNGGGKQALETVQRLLPVLCEQHGLTPDQVVAIASNGGGKQALETVQRLLPVLRQAHGLTPAQVVAIASNGGGRPALESIFAQLSRPDQALAALTNDHLVALACLGGRPALEAVKKGLPHAPTLIKRTNRRLPERTSHRVADHAQVARVLGFFQCHSHPAQAFDEAMTQFGMSRHGLLQLFRRVGVTELEARGGTLPPAPQRWHRILQASGMKRAEPSGASAQTPDQASLHAFADALERELDAPSPIDQAGQALASSSRKRSRSESSVTGSFAQQAVEVRVPEQRDALHLPPLSWGVKRPRTRIGGGLPDPGTPMDADLAASSTVMWEQDADPFAGAADDFPAFNEEEMAWLMELFPQ

SEQ ID NO: 24 - protein, 966 aa, Xanthomonas oryzae
HASRNALTGAPLNLTPAQVVAIASNNGGKQALETVQRLLPVLCQAHGLTPAQVVAIASHDGGKQALETMQRLLPVLCQAHGLTPDQVVAIASNIGGKQALETVQRLLPVLCQAHGLTPDQVVAIASHGGGKQALETVQRLLPVLCQAHGLTPDQVVAIASHDGGKQALETVQRLLPVLCQAHGLTPDQVVAIASNGGGKQALETVQRLLPVLCQAHGLTPDQVVAIASNGGKQALETVQRLLPVLCQAHGLTPDQVVAIASHDGGKQALETVQRLLPVLCQTHGLTPAQVVAIASHDGGKQALETVQQLLPVLCQAHGLTPDQVVAIASNIGGKQALATVQRLLPVLCQAHGLTPDQVVAIASNGGGKQALETVQRLLPVLCQAHGLTPDQVVAIASNGGGKQALETVQRLLPVLCQAHGLTQVQVVAIASNIGGKQALETVQRLLPVLCQAHGLTPAQVVAIASHDGGKQALETVQRLLPVLCQAHGLTPDQVVAIASNGGGKQALETVQRLLPVLCQAHGLTQEQVVAIASNNGGKQALETVQRLLPVLCQAHGLTPDQVVAIASNGGGKQALETVQRLLPVLCQAHGLTPAQVVAIASNIGGKQALETVQRLLPVLCQDHGLTLAQVVAIASNIGGKQALETVQRLLPVLCQAHGLTQDQVVAIASNIGGKQALETVQRLLPVLCQDHGLTPDQVVAIASNIGGKQALETVQRLLPVLCQDHGLTLDQVVAIASNGGKQALETVQRLLPVLCQDHGLTPDQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFGMSRHGLVQLFRRVGVTEFEARYGTLPPASQRWDRILQASGMKRAKPSPTSAQTPDQASLHA

SEQ ID NO: 25 - protein, 901 aa, Xanthomonas oryzae
HAWRNALTGAPLNLTPDQVVAIASNIGGKQALETVQRLLPVLCQAHGLTPDQVVAIASHGGGKQALETVQRLLPVLCQDHGLTPAQVVAIASNIGGKQALETVQRLLPVLCQDHGLTPDQVMAIANNNGGKQALETVQRLLPVLCQDHGLTPDQVMAIANNNGGKQALETVQRLLPVLCQDHGLTPDQVVAIASNIGGKQALETVQRLLPVLCQDHGLTPTQVMAIANNNGGKQALETVQRLLPVLCQDHGLTPDQVVAIASHDGGKQALETVQRLLPVLCQDHGLTPAQVVAIASNIGGKQALETVQRLLPVLCQDHGLTPDQVVAIASHDGGKQALETVQRLLPVLCQDHGLTPDQVVAIASNSGGKQALETVQRLLPVLCQDHGLTPDQVVAIASNSGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIANNNGGKQALETLQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASHDGGKQALETVQRLLPVLCQDHGLTPDQVVAIASNGGGKQALKTVQRLLPVLCQDHGLTPDQVVAIASNGGGKQALESIVAQLSCPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTEFEARYGTLPPASQRWDRILQASGMKRAKPSPTSAQTPDQASLHA

SEQ ID NO: 26 - protein, 1142 aa, Xanthomonas oryzae
HAWRNALTGAPLNLTPDQVVAIASNIGGKQALETVQRLLPVLCQANGLTPDQVVAIASHGGGKQALETVQRLLPVLCQDHGLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNIGGKQALETVQRLLPVLCQDHGLTPDQVVAIASHDGGKQALETVQRLLPVLCQDHGLTPDQVVAIANNNGGKQALETVQRLLPVLCQDHGLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNGGGKQALATVQRLLPVLCQAHGLTPDQVVAIASHDGGKQALETVQRLLPVLCQANGLTPDQVVAIASNGGKQALETVQRLLPVQRLLPVLCQDHGLTQDQVVAIASNIGGKQALETVQRLLPVLCQANGLTQDQVVAIASHDGGKQALETVQRLLPVLCQDHGLTPDQVVAIASHDGGKQALETVQRLLPVLCQDHGLTPAQVVAIANNNGGKQALETVQRLLPVLCQDHGLTPDQVVAIASNSGGKQALETVQRLLPVLCQDHGLTPDQVVAIASNIGGKQALATVQRLLPVLCQDHGLTPDQVVAIANNNGGKQALETVQRLLPVLCQDHGLTPAQVVAIASNNGGKQALETVQRLLPVLCQDHGLTLDQVVAIASNGGSKQALETVQRLLPVLCQDHGLTPDQVVAIANNNGGKQALETVQRLLPVLCQDHGLTLDQVVAIASHDGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHA

SEQ ID NO: 27 - protein, 1390 aa, Xanthomonas oryzae
DPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTKAGELRGPPLQLDTGQLLKIAKRGGVTAVEAVHAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETLQRLLPVLCQDHGLTPDQVVAIANNNGGKQALETLQRLLPVLCQDHGLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNSGGKQALETVQRLLPVLCQDHGLTPDQVVAIASNGGKQALETVQRLLPVLCQDHGLTPDQVVAIASNGGKQALETVQRLLPVQRLLPVLCQDHGLTQDQVVAIASHDGGKQALETVQRLLPVLCQDHGLTPDQVVAIASHDGGKQALETVQRLLPVLCQDHGLTPDQVVAIASNSGGKQALETVQRLLPVLCQDHGLTPDQVVAIASNSGGKQALETVQRLLPVLCQDHGLTPDQVVAIASNNGGKQALETVQRLLPVLCQDHGLTPDQVVAIANNNGGKQALETVQRLLPVLCQDHGLTPAQVVAIASNIGGKQALETVQRLLPVLCQDHGLTLDQVVAIASNGGSKQALETVQRLLPVLCQDHGLTPDQVVAIANNNGGKQALETVQRLLPVLCQDHGLTPDQVVAIASNIGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDP

SEQ ID NO: 28 - protein, 1446 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTEARELRGPPLQLDTGQLLKIAKRGGVTAVEAVHAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIANNNGGKQALETLQRLLPVLCQDHGLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNSGGKQALETVQRLLPVLCQDHGLTPDQVVAIASNGGKQALETVQRLLPVLCQDHGLTPDQVVAIASNGGKQALETVQRLLPVQRLLPVLCQDHGLTQDQVVAIASHDGGKQALETVQRLLPVLCQDHGLTPDQVVAIASHDGGKQALETVQRLLPVLCQDHGLTPDQVVAIASNSGGKQALETVQRLLPVLCQDHGLTPDQVVAIASNSGGKQALETVQRLLPVLCQDHGLTPDQVVAIASNNGGKQALETVQRLLPVLCQDHGLTPDQVVAIANNNGGKQALETVQRLLPVLCQDHGLTPAQVVAIASNIGGKQALETVQRLLPVLCQDHGLTLDQVVAIASNGGSKQALETVQRLLPVLCQDHGLTPDQVVAIANNNGGKQALETVQRLLPVLCQDHGLTPDQVVAIASNIGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVLWEQDAAPFAGAADDFPAFNEEELAWLMELLPQSGSVGGTI

SEQ ID NO: 29 - protein, 1338 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEARELRGPPLQLDTGQLLKIAKRGGVTAVEAVHAWRNALTGAPLNLTPDQVVAIASNIGGNQALETVQRLLPVLCQDHGLTPDQVVAIASHGGKQALETVQRLLPVLCQDHGLTPDQVVAIASNIGGKQALETVQRLLPVLCQAHGLTPAQVVAIASNNGGKQALETVQRLLPVLCQAHGLTPDQVVAIASNNGGKQALETVQRLLPVLCQAHGLTPDQVVAIANNNGGKQALETVQRLLPVLCQDHGLSPDQVVAIANNNGGKQALETLQRLLPVLCQTHALTPDQVVAIANNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNSGGKQALETVQRLLPVLCQDHGLTPDQVVAIASHGGGKQALETVQRLLPVLCQDHGLTPDQVVAIASHDGGKQALETVQRLLPVLCQAHGLTPNQVVAIASNIGGKQALETVQRLLPVLCQDHGLTPDQVVAIASNGGKQALETVQRLLPVLCQAHGLTPDQVVAIASNSGGKQALETVQRLLPVLCQDHGLTPNQVVAIASNIGGKQALETVQRLLPVLCQDHGLTPDQVVAIASNIGGKQALETVQRLLPVLCQAHGLTLDQVVAIASHDGGKQALETVQRLLPVLCQAHGLTPDQVVAIASHDGGKQALETVQRLLPVLCQAHGLTLDKVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 30 - protein, 1483 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVEAVHAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHGGGKQALETVQRLLPVLCQAHGLTPDQVVAIARHDGGKQALETVQRLLPVLCQAHGLTPDQVVAIANNNGGKQALETVQRLLPVLCQAHGLTPDQVVAIASHDGGKQALETVQRLLPVLCQAHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIANNNGGKQALETVQRLLPVQRLVPVLCQDHGLTQDQVVAIASNIGGKQALETVQRLLPVLYQDHGLTQDQVVAIASHDGGKQALETVQRLLPVLCQDHGLTPDQVVAIASHDGGKQALETVQRLLPVLCQEHGLTPDQVVAIASHDGGKQALETVQRLLPVLCQDHGLTPDQVVAIASHGGGKQALGTVQRLLPVLCQDHGLTPDQVVAIANNNGGKQALETVQRLLPVLCQDHGLTPDQVVAIANNNGGKQALETVQRLLPVLCQAHGLTPDQVVAIASHDGGKQALETVQRLLPVLCQDHGLTPAQVVAIASNSGGKQALETVQRLLPVLCQDHGLTPAQVVAIANNNGGKQALETVQRLLPVLCQDHGLTPDQVVAIASHDGGKQALETVQRLLPVLCQDHGLTPDQVVAIASNGGGKQALATVQRLLPVLCQAHGLTPDQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 31 - protein, 1446 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVEAVHAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIANNNGGKQALETLQRLLPVLCQDHGLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNSGGKQALETVQRLLPVLCQDHGLTPDQVVAIASNGGKQALETVQRLLPVLCQDHGLTPDQVVAIASNGGKQALETVQRLLPVQRLLPVLCQDHGLTQDQVVAIASHDGGKQALETVQRLLPVLCQDHGLTPDQVVAIASHDGGKQALETVQRLLPVLCQDHGLTPDQVVAIASNSGGKQALETVQRLLPVLCQDHGLTPDQVVAIASNSGGKQALETVQRLLPVLCQDHGLTPDQVVAIASNNGGKQALETVQRLLPVLCQDHGLTPDQVVAIANNNGGKQALETVQRLLPVLCQDHGLTPAQVVAIASNIGGKQALETVQRLLPVLCQDHGLTLDQVVAIASNGGSKQALETVQRLLPVLCQDHGLTPDQVVAIANNNGGKQALETVQRLLPVLCQDHGLTPDQVVAIASNIGGKQALETVQRLLPVLCQDHGLTLDQVVAIASNGGKQALETVQRLLPVLCQDHGLTPDQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 32 - protein, 627 aa, Xanthomonas oryzae
HAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIANNNGGKQALETLQRLLPVLCQDHGLTPDQVVAIASNIGGKQALETVQRLLPVLCQDHGLTLDQVVAIASNGGSKQALETVQRLLPVLCQDHGLTPDQVVAIANNNGGKQALETVQRLLPVLCQDHGLTPDQVVAIASNIGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGSPALDAVKKGLPHAPELIRRINRRIPERTSHRVPDLAHVVRVLGFFQSHSHPAQAFDDAMKQFEMSRHGLVQLFRRVGVTEFEARYGTLPPASQRWDRILQASGMKRAKPSPTSAQTPDQASLHA

SEQ ID NO: 33 - protein, 767 aa, Xanthomonas oryzae
HAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIANNNGGKQALETLQRLLPVLCQDHGLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNSGGKQALETVQRLLPVLCQDHGLTPDQVVAIASNGGKQALETVQRLLPVLCQDHGLTPDQVVAIASNGGKQALETVQRLLPVQRLLPVLCQDHGLTQDQVVAIASHDGGKQALETVQRLLPVLCQDHGLTPDQVVAIASHDGGKQALETVQRLLPVLCQDHGLTPDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGSPALDAVKKGLPHAPELIRRINRRIPERTSHRVPDLAHVVRVLGFFQSHSHPAQAFDDAMKQFEMSRHGLVQLFRRVGVTEFEARYGTLPPASQRWDRILQASGMKRAKPSPTSAQTPDQASLHA

SEQ ID NO: 34 - protein, 796 aa, Xanthomonas oryzae
HAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPAQVVAIASHGGGKQALETVQRLLPVLCQAHGLTPDQVVAIASHDGGKQALETVQRLLPVLCQAHGLTPNQVVAIASNIGGKQALETVQRLLPVLCQDHGLTPDQVVAIASNGGKQALETVQRLLPVLCQAHGLTPDQVVAIASNSGGKQALETVQRLLPVLCQDHGLTPNQVVAIASNIGGKQALETVQRLLPVLCQDHGLTPDQVVAIASNIGGKQALETVQRLLPVLCQDHGLTLDQVVAIASHGGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHA

SEQ ID NO: 35 - protein, 491 aa, Xanthomonas oryzae
HAWRNALTGAPLNLTPNQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIASNIGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHA

SEQ ID NO: 36 - protein, 720 aa, Ralstonia solanacearum
MRIGKSSGWLNESVSLEYEHVSPPTRPRDTRRRPRAASDGGLAHLHRRLAVGYAEDTPRTGARSPAPRRPLPVAPASAPPAPSLVPEPPMPVSLPVVSSPRFSAGSSAAITDPFSSLPPTPVLYAMARELKALSDATWQPAVPLPAEPPTDARRGNTVFDEASASSPVIASACPQAFASPPRAPRSARARRARTGGDAWPAPTFLSRPSSSRIGRDVFGKLVALGYSREQIRKLKQESLSEIAKYHTTLTGQGFTHADICRISRRRQSLRVVARNYPELAAALPELTRAHIVDIARQRSGDLALQALLPVATALTAAPLRLSASQIATVAQYGERPAIQALYRLRRKLTRAPLHLTPQQVVAIASHDGGKPALEAVWAKLPVLRGVPYALSTAQVVAIACISGQQALEAIEAHMPTLRQAPHSLSPERVAAIACIGGRSAVEAVRQGLPVKAIRRIRREKAPVAGPPPASLGPTPQELVAVLHFFRAHQQPRQAFVDALAAFQTTRPALLRLLSSVGVTEIEALGGTIPDATERWQRLLGRLGFRPATGAAAPSPDSLQGFAQSLERTLGSPGMAGQSACSPHRKRPAETAIAPRSIRRRPNNAGQPSEPWPDQLAWLQRRKRTARSHIRADSAASVPANLHLGTRAQFTPDRLRAEPGPIMQAHTSPASVSFGSHVAFEPGLPDPGTPTSADLASFEAEPFGVGPLDFHLDWLLQILEA

SEQ ID NO: 37 - protein, 755 aa, Xanthomonas oryzae
MDPIRPRRPSPARELLPGPQPDRVQPTADRGGAPPAGGPLDGLPARRTVSRTRLPSPPAPSPAFSAGSFSDLLRPFDPSLPDTSLFDSMPAVGTPHTAAAPAEWDEMQSALRAADDPSPTVRVAVTAARQPRAKPAPRRRAAQPSDASPAAQVDLRTLGYSQQQQEKIKPNVRSTVAQHHEALVGHGFTHAHIVALSQHPAALGTVAVTYQHIITALPEATHEDIVGVGKQWSGARALEALLTKAGELRGPPLQLDTGQLLKIAKRGGVTAVEAVHASRNALTGAPLNLTPAQVVAIASNGGKQALETVQRLLPVLCQAHGLTLDQVVAIASNNGGKQALETVQRLLPVLCQARGLTPDQVVAIASHDGGKQALETVQRLLPVLCQDHGLIPAQVVAIASHDGGKQALETVQRLLPVLCQDHGLTPDQVVAIASHDGGKQALETVQRLLPVLCQDHGLTPDQVVAIASNGGGKQALESIVAQLSRPDPALAALTNDHLVALACLGGRPALDAVKKGLPHAPELIRRVNSRIGERTSHRVADYAQVVRVLEFFQSHSQPAQAFDDAMTQFGMSRHGLVQLFRRVGVTELEASGGTLPPASQRWHRILQASGMKRAKPSPTSAQTPDQASLHAFADSLERDPDAPSPMHEGDQTRASSRKRSRSDRAVTGPSAQQSFEVRVPEQRDALHLPLSWSVKRPRTRIGGGLPDPGTPMAADLAASSTVMWEQDADPFAGAADDFPAFNEEELAWLMELLPQ

SEQ ID NO: 38 - protein, 1129 aa, Xanthomonas oryzae
  MOD_RES (1097)..(1097): Any amino acid
MDPIRPRRPSPARELLPGPQPDRIQPTADRGGAPPAGGPLDGLPARRTMSRTRLPSPPAPSPAFSAGSFSDLLRPFDPSLLDTSLLDSMPAVGTPHTAAAPAEWDEMQSALRAADDPPPTVCVAVTAARPPRAKPAPRRRAAQPSDASPAAQVDLRTLGYSQQQQEKIKPNVRSTVAQHHEALVGHGFTHAHIVALSQHPAALGTVAVKYQHIITALPEATHEDIVGVGKQWSGARALEALLTDAGELRGPPLQLDTGQLLKIAKRGGVTAVEAVHASRNALTGAPLNLTPDQVVAIASNSGGKQALEMVQRLLPVLCQAHGLTPAQVVAIASHDGGKQALETVQRLLPVLCQAHGLTPDQVVAIASNIGGKQALETVQRLLPVLCQAHGLTPDQVVAIASNGGKQALETVQRLLPVLCQAHGLTPDQVVAIASNIGGKQALETVQRLLPVLCQDHGLTPDQVVAIASHGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIANNNGGKQALETLQRLLPVLCQAHGLTPAQVVAIASNIGGKQALETVQRLLPVLCQAHGLTPDQVVAIASNGGSKQALETVQRLLPVLCQDHGLTPDQVVAIASHDGGKQALETVQRLLPVLCQDHGLTPAQVVAIANNNGGKQALETVQRLLPVLCQDHGLSPAQVVAIASNSGGKQALETVQRLLPVLCHDHGLTPAQVVAIANNNGGKQALETVQRLLPVLCQDHGLTPAQVVAIASNGGGKQALETVQRLLPVLCQDHGLTPDQVVAIASNNGGKQALESIVAHLSRPDPALAALTNDHLVALACLGGRPALDAVKKGLPHAPELIRRVNSRIGERTSHRVADYAQVVRVLEFFQCHSHPAHAFDEAMTQFGMSRNGLLQLFRRVGVTELEARGGTLPPASQRWHRILQASGMKRAEPSPTSAQTPDQASLHAFADSLERDLDAPSPMHEGDQTRASSRKRSRSDRAVTGPSAQQAVEVRVPEQRDALHLPLSWRVKRPRTRIGGGLPDPGTPMAADLAASSTVXWEQDAAPFAGAADDFPAFNEEELAWLRELLPQ

SEQ ID NO: 39 - protein, 1230 aa, Xanthomonas oryzae
MDPIRPRRPSPARELLPGPQPDRIQPTADRGGAPPAGGPLDGLPARRTMSRTRLPSPPAPSPAFSAGSFSDLLRPFDPSLLDTSLLDSMPAVGTPHTAAAPAEWDEMQSALRAADDPPPTVCVAVTAARPPRAKPAPRRRAAQPSDASPAAQVDLRTLGYSQQQQEKIKPNVRSTVAQHHEALVGHGFTHAHIVALSQHPAALGTVAVKYQHIITALPEATHEDIVGVGKQWSGARALEALLTDAGELRGPPLQLDTGQLLKIAKRGGVTAVEAVHASRNALTGAPLNLTPDQVVAIASNSGGKQALEMVQRLLPVLCQAHGLTPAQVVAIASHDGGKQALETVQRLLPVLCQAHGLTPDQVVAIASNIGGKQALETVQRLLPVLCQAHGLTPDQVVAIASNGGKQALETVQRLLPVLCQAHGLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQDHGLTLEQVVAIASNIGGKQALETVQRLLLVLCQAHGLTPDQVVAIASNGGKQALETVQRLLPVLCQAHGLTPDQVVAIASNGGGKQALETVQRLLPVLCQDHGLTPDQVVAIASHDGGKQALETVQRLLPVLCQDHGLTPDQVVAIANNNGGKQALETLQRLLPVLCQAHGLTPAQVVAIASNIGGKQALETVQRLLPVLCQAHGLTPDQVVAIASNGGSKQALETVQRLLPVLCQDHGLTPDQVVAIASHDGGKQALETVQRLLPVLCQDHGLTPAQVVAIANNNGGKQALETVQRLLPVLCQDHGLSPAQVVAIASNSGGKQALETVQRLLPVLCHDHGLTPAQVVAIANNNGGKQALETVQRLLPVLCQDHGLTPAQVVAIASNGGGKQALETVQRLLPVLCQDHGLTPDQVVAIASNNGGKQALESIVAHLSRPDPALAALTNDHLVALACLGGRPALDAVKKGLPHAPELIRRVNSRIGERTSHRVADYAQVVRVLEFFQCHSHPAHAFDEAMTQFGMSRNGLLQLFRRVGVTELEARGGTLPPASQRWHRILQASGMKRAEPSPTSAQTPDQASLHAFADSLERDLDAPSPMHEGDQTRASSRKRSRSDRAVTGPSAQQAVEVRVPEQRDALHLPLSWRVKRPRTRIGGGLPDPGTPMAADLAASSTVMWEQDAAPFAGAADDFPAFNEEELAWLRELLPQ

SEQ ID NO: 40 - protein, 498 aa, Xanthomonas oryzae
MAASRRWRRCSGCCRCCARTMALTPDQVVAIASNGGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASHDGGKQALETVQRLLPVLCQDHGLTPDQVVAIASNGGGKQALKTVQRLLPVLCQDHGLTPDQVVAIASNGGGKQALESIVAQLSCPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTDPSAQQSFEVRVPEQHDTLHLPLSWRVKRPRTRIGGGLPDPGTPIAADLAASSTVMWEQDAAPFAGAADDFPAFNEEELAWLMELLPQSGSVGGTI

SEQ ID NO: 41 - protein, 1072 aa, Xanthomonas oryzae
MGSLAVSTEISHNPLPILHAGPGSPSCLRLTLVVEGCQDHPKLCTAMRPGKLCRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEAQSGLRAADDPPPTVPVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTKAGELRGPPLQLDTGQLVKIAKRGGVTAVEAVHASRNALTGAPLNLTPDQVVAIASNIGGKQALETVQRLLPVLCQDHGLTPDQVVAIANNNGGKQALETVQRLLPVLCQDHGLTPDQVVAIASNIGGKQALETVQRLLPVLCQDHGLTPDQVVAIASHGGGKQALETVQRLLPVLCQDHGLTPDQVVAIASHGGGKQALETLQRLLPVLCQDHGLTPDQVVAIASHDGGKQALETVQRLLPVLCQDHGLTPDQVVAIASNGGGKQALETLQRLLPVLCQDHGLTPDQVVAIASHDGGKQALETVQRLLPMLCQDHGLTPDQVVAIASHGGGKQALETVQRLLPVLCQDHGLTPDQVVAIASHDGGKQALETVQRLLPVLCQDHGLTLDQVVAIASHDGGKKALETVQRLLPVLCQDHGLTPDQVVAIASHDGGKQALETVQRLLPVLCQDHGLTPDQVVAIASNGGGKQALESIVAQLSRPDPALAALTNDHLVALACLGGRPALDAVKKGLPHAPELIRRVNRRIGERTSHRVADYAQVVRVLEFFQCHSHPAQAFDDAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 42 - protein, 793 aa, Xanthomonas oryzae
MQRLLPVLCQDHGLTPDQVVAIASHDGGKQALETVQRLLPVLCQDHGLTPAQAVAIASNGGGKQALETVQRLLPVLCQDHGLTPDQVVAIASNGGKQALETVQRLLPVLCQDHGLTPDQVVAIASNGGKQALETVQRLLPVLCQDHGLTLAQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPAQVVAIASHIGGKQALETVQRLLPVLCQDHGLTLDQVVAIASNDGSKQALETVQRLLPVLCQDHGLTPDQVVAIASHDGGKQALETVQRLLPVLCQDHGLTPNQVVAIASNIGGKQALETVQRLLPVLCQAHGLTPDQVVAIASHDGGKQALETVQRLLPVLCQNHGLTPDQVVAIASNGGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADYAQVVRVLEFFQCHSHPAYAFDEAMTQFGMSRNGLVQLFRRVGVTELEARCGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 43 - protein, 351 aa, Xanthomonas oryzae
MCTAMRPGKLCRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEAQSGLRAADDPPPTVRVAVTAARPPRAKPAPRRRAAQPSDASPAAQVDLRTLGYSQQQQEKIKPKVRSTVARHHEALVGHGFTHAHIVALSQHPAALGTVAVTYQDIIRALPEATHEDIVGVGKQWSGARALEALLTEAGELRGPPLQLDTGQLLKIAKRGGVTAVEAVHAWRNALTGAPLNLTPAQVVAIASHDGGNQALETVQRLLPVLCQDHGP

SEQ ID NO: 44 - protein, 1199 aa, Xanthomonas oryzae
MCTAMRPRKLCRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVQAVHAWRNALTGAPLNLTPDQVVAIASNIGGKQALETVQRLLPVLCQAHGLNPDQVVAIASNSGGKQALETVQRLLPVLCQDHGLTLDQVVAIASHDGGKQALETVQRLLPVLCQDHGLTPDQVVAIASNGGGKQALETVQRLLPVLCQDHGLTPDQVVAIASNSGGKQALETVQRLLPVLCQDHGLSPDQVVAIANNNGGKQALETVQRLLPVLCQDHGLSPDQVVAIASHDGGKQALETVQRLLPVLCQDHGLTPDQVVAIASNGGKQALETVQRLLPVLCQDHGLTPDQVVAIANNNGGKQALETVQRLLPVLCQDHGLTPDQVVAIANNNGGKQALETVQRLLPVLCQAHGLPPDQVVAIASNIGGKQALETVQRLLPVLCQDHGLTPDQVVAIANNNGGKQALETVQRLLPVLCQDHGLTPDQVVAIASHDGGKQALETVQRLLPVLCQDHGLTPDQVVAIASNGGGKQALETVQRLLPVLCQDHGLSPDQVVAIASHDGGKQALETVQRLLPVLCQDHGLTLDQVVAIASHDGGKQALETVQRLLPVLCQAHGLTPDQVVAIASHDGGKQALETVQRLLPVLCQDHGLTPDQVVAIASNGGGKQALESIVAQLYRPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPIAADLAASSTVMWEQDADPFAGAADDFPAFNEEELAWLMELLPQSGSVGGTI

SEQ ID NO: 45 - protein, 1268 aa, Xanthomonas oryzae
MCTAMRPRKLRRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVEAVHAWRNALTGAPLNLTPDQVVAIASNIGGNQALETVQRLLPVLCQAHGLTPDQVVAIASHGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIANNNGGKQALETVQRLLPVLCQDHGLTPDQVVAIASHDGGKQALETVQRLLPVLCQGHGLTPDKVVAIASNSGGKQALETVQRLLPVLCQAHGLTPDKVVAIANNNGGKQALETVQRLLPVLCQDHGLTPDQVVAIASNSGGKQALETVQRLLPVLCQDHGLTPAQVVAIANNNGGKQALETVRRLLPVLCQDHGLTPDQVVAIASHDGGKQALETVQRLLPVLCQDHGLTPDQVVAIANNNGGKQALETVQRLLPVLCQDHGLTQDQVVAIASNIGGKQALETVQRLLPVLCQDHGLTPDQVVAIASHDGGKQALETVQRLLPVLCQDHGLTPAQVVAIANNNGGKQALETVQRLLPVLCQDHGLSPDQVVAIASNIGGKQALETVQRLLPVLCQDHGLTPDQVVAIASNGGGKQALETVQRLLPVLCQDHGLSPDQVVAIASHDGGKQALETVQRLLPVLCQDHGLTPDQVVAIASNGGGKQALESIVAQLSRPDPALAALTNDHLVALACLGGRPAMDAVKKGLPHAPELIRRVNSRIGERTSHRVADYAQVVRVLEFFQCHSHPAYAFDEAMTQFGMSRNGLLQLFRRVGVTELEARGGTLPPASQRWDRILQASGMKRAKPSPTSAQTPDQASLHAFADSLERDLDAPSPMHEGDQTGASSRKRSRSDRAVTGPSAQQSFEVRVPEQHDALHLPLSWRVKRPRTRIGGGLPDPGTPIAADLAASSTVLWEQDAAPFAGAADDFPAFNEEELAWLMELLPQSGSVGGTI

SEQ ID NO: 46 - protein, 1403 aa, Xanthomonas oryzae
MCTAMRPGKLCRDHRPLVWRRPCKEVCLMDPIRSRTPSPARELLPGPQPDRVQPTADRGGAPPAGGPLDGLPARRTMSRTRLPSPPAPSPAFSAGSFSDPLRQFDPSLLDTSLFDSMPAVGTPHTAAAPAEWDEAQSALRAADDPPPTVRVAVTAARPPRAKPAPRRRAAQPSDASPAAQVDLRTLGYSQQQQEKIKPKVRSTVAQHHEALVGHGFTHAHIVALSKHPAALGTVAVTYQHIITALPEATHEDIVGVGKQWSGARALEALLTDAGELRGPPLQLDTGQLLKIAKRGGVTAVEAVHASRNALTGAPLNLTPAQVVAIASNNGGKQALETVQRLLPVLCQAHGLTPAQVVAIASHDGGKQALETVQRLLPVLCQDHGLTPDQVVAIASNSGGKQALETVQRLLPVLCQDHGLTPDQVVAIASNGGGKQALETVQRLLPVLCQDHGLTPDQVVAIASHDGGKQALETVQRLLPVLCQDHGLTPDQLVAIANNNGGKQALETVQRLLPVLCQDHGLTPDQVVAIASNGGKQALETVQRLLPVLCQDHGLTPDQVVAIASNIGGKQALETVQRLLPVLCQAHGLTPAQVVAIASHDGGKQALETMQRLLPVLCQAHGLTPAQVVAIASNSGGKQALETVQRLLPVLCQDHGLTPAQVVAIVSHDGGKQALETVQRLLPVLCQAHGLTPDQVVAIASNNGGKQALETVQRLLPVLCQDHGLTPDQVVAIASHDGGKQALGTVQRLLPVLCQDHGLTPDQVVAIASNNGGKQALETVQRLLPVLCQDHGLTPDQVVAIASHDGGKQALETVQRLLPVLCQAHGLTPAQVVAIASNNGGKQALETVQRLLPVLCQDHGLTPDQVVAIANNNGGKQALETVQRLLPVLCQAHGLTPAQVVAIASNNGSKQALETVQRLLPVLCQAHGLTPAQVVAIASNNGGKQALETVQRLLPVLCQAHGLTPDQVVAIASNNGGKQALETVQRLLPVLCQAHGLTPDQVVAIASNNGGKQALETVQRLLPVLCQAHGLTPDQVVAIASNNGGKQALETVQRLLPVLCQDHGLTPAQVVAIASHDGGKQALETVQRLLPVLCQDHGLTPAQVVAIASNGGGKQALESIVAQLSRPDPALAALTNDHLVALACLGGRPALDAVKKGLPHAPELIRRVNSRIGERTSHRVADYAQVVRVLEFFQCHSHPAYAFDEAMTQFGMSRNGLLQLFRRVGVTELEARGGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPMAADLAASSTVMWEQDAAPFAGAADDFPAFNEEELAWLMELLPQSGSVGGTI

SEQ ID NO: 47 - protein, 1171 aa, Xanthomonas oryzae
MCTAMRPGKLCRDHRPLVWRRPCKEVCLMDPIRSRTPSPARELLPGPQPDRVQPTADRGGAPPAGGPLDGLPARRTMSRTRLPSPPAPSPAFPAGSFSDLLRQVDTSLLDSMPAVGTPHTAAAPAEWDEMQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTKAGELRGPPLQLDTGQLLKIAKRGGVTAVEAVHAWRNALTGAPLNLTPDQVVAIASNIGGKQALETVQRLLPVLCQAHGLTPDQVVAIANNNGGKQALETVQRLLPVLCQDHGLTPAQVVAIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNSGGKQALETVQRLLPVLCQDHGLTPAQVVAIASHGGGKQALETVQRLLPVLCQAHGLTPDQVVAIASHDGGKQALETVQRLLPVLCQAHGLTPNQVVAIASNIGGKQALETVQRLLPVLCQDHGLTPAQVVAIASNGGKQALETVQRLLPVLCQAHGLTPDQVVAIASNSGGKQALETVQRLLPVLCQDHGLTPNQVVAIASNIGGKQALETVQRLLPVLCQDHGLTPDQVVAIASNIGGKQALETVQRLLPVLCQDHGLTPAQVVAIANNNGGKQALETVQRLLPVLCQDHGLTPDQVVAIASNIGGKQALETVQRLLPVLCQDHGLTPDQVVAIASNGGGKQALESIVAQLSRPDPALAALTNDHLVALACLGGRPALDAVKKGLPHAPELIKRINRRIPERTSHRVADLPERTSHRVADLAHVVRVLGFFQSHSHPAQAFDDAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQHDALHLPLSWRVKRPRTRIGGGLPDPGTPIAADLAASSTVMWEQDAAPFAGAADDFPAFNEEELAWLMELLPQSGSVGGTI

SEQ ID NO: 48 - protein, 1502 aa, Xanthomonas oryzae
MCTAMRPRKLCRDHRPLVWRQPCKEVCLMDPIRSRTPSPARELLPGPQPDRVQPTADRGGTPPAGGPLDGLPVRRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEARELRGPPLQLDTGQLLKIAKRGGVTAVEAVHAWRNALTGAPLNLTPDQVVAIASNIGGNQALETVQRLLPVLCQAHGLTPDQVVAIASNGGKQALETVQRLLPVLCQDHSLTPDQVVAIASNIGGKQALETVQRLLPVLCQDHGLTPDQVVAIASNSGGKQALETVQRLLPVLCQDHGLTPDQVMTIASNNGGKQALETVQRLLPVLCQDHGLTPDQVVTIASNGGGKQALETVQRLLPVLCQAHGLTPDQVVAIANNNGGKQALETVQRLLPVLCQAHGLTPAQVVAIASNSGGKQALETVQRLLPVLCQAHGLTPDQVVAIASNGGKQALETVQRLLPVLCQAHGLTPDQVVAIASNSGGKQALETVQRLLPVLCQAHGLTPDQVVAIANNNGGKQALETVQRLLPVLCQAHGLTPDQVVAIASNSGGKQALETVQRLLPVLCQDHGLTPDQVVAIASNGGKQALETVQRLLPVLCQDHGLTPDQVVAIASHDGGKQALETVQRLLPVLCQDHGLTLDQVVAIASHGGGKQALETVQRLLPVLCQDHGLTSDQVVAIASHDGGKQALETVQRLLPVLCQDHGLTPDQVVAIASHDGGKQALETVQRLLPVLCQDHGLTLDQVVAIASHDGGKQALETVQRLLPVLCQAHGLTPDQVVAIASNSGGKQALETVQRLLPVLCQDHGLTPDQVVAIASNGGKQALETVQRLLPVLCQDHGLTPDQVVAIASHDGGKQALETVQRLLPVLCQDHGLTLDQVVAIASHGGGKQALETVQRLLPVLCQDHGLTSDQVVAIASHDGGKQALETVQRLLPVLCQDHGLTPDQVVAIASHDGGKQALETVQRLLPVLCQDHGLTLDQVVAIASHDGGKQALETVQRLLPVLCQDHGLTPDQVVAIASHDGGKQALETVQRLLPVLCQDHGLTPAQVVAIASNGGGKQALESIVAQLSRPDPALAALTNDHLVALACLGGRPALDAVKKGLPHAPELIRRINRRIPERTSHRVADYAQVVRVLEFFQCHSHPAYAFDEAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 49 - protein, 1321 aa, Xanthomonas oryzae
MGSLAVSTEISHNPLPILHAGPGSPSCLRLTLVVEGCQDHPKLCTAMRPGKLCRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSIPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTKAGELRGPPLQLDTGQLLKIAKRGGVTAVEAVHAWRNALTGAPLNLTPDQVVAIASNIGGNQALETVQRLLPVLCQAHGLTPDQVVAIASHGGGKQALETVQRLLPVLCQDHGLTPDQVVAIASNIGGKQALETVQRLLPVLCQDHGLTPDQVVAIASNGGGKQALETLQRLLPVLCQAHGLTPDQVLAIASHGGGKQALETLQRLLPVLCQDHGLTPAQVVALASHDGGKQALETVQRLLPVLCQDHGLTPAQVVAIASNSGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIANNNGGKQALETVQRLLLVLCQAHGLTPDQVVAIASNGGGKQALETVQRLLPVLCQDHGLTPDQVVAIASHGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHGGGKQALETVQRLLPVLCQDHGLTPDQVVAIASHDGGKQALETVQRLLPVLCQDHGLTPDQVVAIASHDGGKQALETVQRLLPVLCQDHGLTLDQVVAIASNIGGKQALETVQRLLPVLCQDHGLTPDQVVAIANNNGGKQALETVQRLLPVLCQDHGLTPDQVVAIASNGGGKQALESIVAQLSCPDPALAALTNDHLVALACLGGRPALDAVKKGLPHAPELIRRINRRIPERTSHRVADLPERTSNRVADLAHVVRVLGFFQSHSHPAQAFDDAMTQFGMSRHGLVQLFRRVGVTELEARCGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPIAADLAASSTVLWEQDAAPFAGAADDFPAFNEEELAWLMELLPQSGSVGGTI

SEQ ID NO: 50 - protein, 1499 aa, Xanthomonas oryzae
MGRFWFSGTSILHTRKLRHRALRHAVLGADLRHRTGVVADDVRRTQYALGDPANAYCHQVSGGAFVSRRRNDLPAGRTRGLAGIRIKKQPKVGSLAVSTEIFHNLLPILHAGPGSPSCLRLTLVVEGCQDHPKLCTAMRPRKLCRDHRPLVWRQPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEARELRGPPLQLDTGQLLKIAKRGGVTAVEAVHAWRNALTGAPLNLTPDQVVAIASNIGGNQALETVQRLLPVLCQDHGLTPDQVVAIASHGGKQALETVQRLLPVLCQDHGLTPDQVVAIASNIGGKQALETVQRLLPVLCQAHGLTPAQVVAIASNNGGKQALETVQRLLPVLCQAHGLTPAQVVAIASNNGGKQALETVQRLLPVLCQAHGLTPDQVVAIANNNGGKQALETVQRLLPVLCQDHGLSPDQVVAIANNNGGKQALETLQRLLPVLCQTHALTPDQVVAIANNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNSGGKQALETVQRLLPVLCQDHGLTPAQVVAIASHGGGKQALETVQRLLPVLCQAHGLTPDQVVAIASHDGGKQALETVQRLLPVLCQAHGLTPNQVVAIASNIGGKQALETVQRLLPVLCQDHGLTPAQVVAIASNGGKQALETVQRLLPVLCQAHGLTPDQVVAIASNSGGKQALETVQRLLPVLCQDHGLTPNQVVAIASNIGGKQALETVQRLLPVLCQDHGLTPDQVVAIASNIGGKQALETVQRLLPVLCQDHGLTLDQVVAIASHDGGKQALETVQRLLPVLCQAHGLTPYQVVAIASNGGKQALETVQRLLPVLCQAHGLTPNQVVAIASNSGGKQALETVQRLLPVLCQDHGLTPNQVVAIASNIGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDALSPMHEGDQTRASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 51 - protein, 1267 aa, Xanthomonas oryzae
MCTAMRPRKLCRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIITALPEATHEDIVGVGKQWSGARALEALLTEARELRGPPLQLDTGQLLKIAKRGGVTAVEAVHAWRNALTGAPLNLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIANNKGGKQALETLQRLLPVLCQAHGLTPDQVVAIASNGGGKQALETVQRLLPVLCQDHGLTPAQVVAIASNIGGKQALETVQRLLPVLCQDHGLTPDQVVAIANNNGGKQALETVQRLLPVLCQDHGLTPDQVVTIASNIGGKQALEMVQRLLPVLCQDHGLTPDQVVAIANNNGGKQALETVQRLLPVLCQAHGLTPDQVVAIASNIGGKQTLETVQRLLPVLCQDHGLTPDQVVAIANNNGGKQALETVQRLLPVLCQDHGLTPDQVVAIASNSGGKQALETVQRLLPVLCQDHGLTPNQVVAIASNGGGKQALETVQRLLPVLCQDHGLTPDQVVGIASNSGGKQALETVQRLLPVLCQDHGLTPDQVVAIANNNGGKQALETVQRLLPVLCQDHGLTPDQVVAIASNIGGKQALETVQRLLPVLCQDHGLTLDKVVAIASNGGKQALETVQRLLPVLCQDHGLTPDQVVAIASNSGGKQALETVQRLLPVLCQDHGLTPDQVVAIASNGGGKQALESIVAQLSRPDPALAALTNDHLVALACLGGRPAMDAVKKGLPHAPELIRRVNRRIGERTSHRVADYAQVVRVLEFFQCHSHPAYAFDEAMTQFGMSRNGLVQLFRRVGVTELEARGGTLPPASQRWDRILQASGMKRAKPSPTSAQTPDQASLHAFADSLERDLDAPSPMHEGDQTGASSRKRSRSDRAVTGPSAQQSFEVRVPEQHDALHLPLSWRVKRPRTRIGGGLPDPGTPIAADLAASSTVLWEQDAAPFAGAADDFPAFNEEELAWLMELLPQSGSVGGTI

SEQ ID NO: 52 - protein, 1790 aa, Xanthomonas oryzae
MGSLAVSTEISHNPLPILHAGPGSPSCLRLTLVVEGCQDHPKLCTAMRPGKLCRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTKAGELRGPPLQLDTGQLLKIAKRGGVTAVEAVHAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETLQRLLPVLCQDHGLTPDQVVAIANNNGGKQALETLQRLLPVLCQDHGLTPDQVVAIASHDGGKQALETVQRLLPVLCQDHGLTPDQVVAIASHGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHGGGKQALETVQRLLPVLCQAHGLTPDQVVAIARHDGGKQALETVQRLLPVLCQAHGLTPDQVVAIANNNGGKQALETVQRLLPVLCQAHGLTPDQVVAIASHDGGKQALETVQRLLPVLCQAHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIANNNGGKQALETVQRLLPVQRLVPVLCQDHGLTQDQVVAIASNIGGKQALETVQRLLPVLYQDHGLTQDQVVAIASHDGGKQALETVQRLLPVLCQDHGLTPDQVVAIASHDGGKQALETVQRLLPVLCQEHGLTPDQVVAIASHDGGKQALETVQRLLPVLCQDHGLTPDQVVAIASHGGGKQALGTVQRLLPVLCQDHGLTPDQVVAIANNNGGKQALETVQRLLPVLCQDHGLTPDQVVAIANNNGGKQALETVQRLLPVLCQAHGLTPDQVVAIASHDGGKQALETVQRLLPVLCQDHGLTPAQVVAIASNSGGKQALETVQRLLPVLCQDHGLTPAQVVAIANNNGGKQALETVQRLLPVLCQDHGLTPDQVVAIASHDGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTDPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 53 - protein, 1279 aa, Xanthomonas oryzae
MGSLAVSTEIFHNLLPILHAGPGSPSCLRLTLVVEGCQDHPKLCTAMRPRKLCRDHRPLVWRQPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTKAGELRGPPLQLDTGQLLKIAKRGGVTAVEAVHAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETLQRLLPVLCQDHGLTPDQVVAIANNNGGKQALETLQRLLPVLCQDHGLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNSGGKQALETVQRLLPVLCQDHGLTPDQVVAIASNGGKQALETVQRLLPVLCQDHGLTPDHVVAIASNGGKQALETVQRLLPVQRLLPVLCQDHGLTQDQVVAIASHDGGKQALETVQRLLPVLCQDHGLTPDQVVAIASHDGGKQALETVQRLLPVLCQDHGLTPDQVVAIASNSGGKQALETVQRLLPVLCQDHGLTPDQVVAIASNSGGKQALETVQRLLPVLCQDHGLTPDQVVAIASNNGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 54 - protein, 1080 aa, Xanthomonas oryzae
MGDVAGGVEGCQDPPKLCTAMRPRKLCRDHRPLVWRRTCKEVCLMDPIRSRTPSPARELLPGPQPDRVQPTADRGGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTKAGELRGPPLQLDTGQLLKIAKRGGVTAVEAVHAWRNALTGAPLNLTPDQVVAIASNIGGKQALETVQRLLPVLCQAHGLTPDQVVAIASHGGGKQALETVQRLLPVLCQDHGLTPAQVVAIASNIGGKQALETVQRLLPVLCQDHGLTPAQVMAIANNNGGKQALETVQRLLPVLCQDHGLTPAQVVAIASNIGGKQALETVQRLLPVLCQDHGLTPTQVMAIANNNGGKQALETVQRLLPVLCQAHGLTPDQVVAIASHDGGKQALETVQRLLPVLCQAHGLTPDQVVAIASHDGGKQALETVQRLLPVLCQDHGLTPAQVVAIASHDGGKQALETVQRLLPVPVLCQAHGLTPDQVVAIASHDGGKQALETVQRLLPVLCQDHGLTPDQVVAIASNSGGKQALETVQRLLPVLCQDHGLTPDQVVAIASNSGGKQALETVQRLLPVPVLCQAHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHDGGKQALETVQRLLPVLCQDHGPDPGPGRGHRQQWRRQAGAGDGATAVAGAVPGPWPDPGPGRGHRQPRWRQAGAGDGAAAVAGAVPGPWPDPGPSGGHRQPRWRQAGAGDGAAAVAGVVPGPWPDPGPGGGHRQPRWRQAGAGDGAAAVAGAVPGPWPDPGPGGGHRQQWRRQAGAEDGAAAVAGAVPGPWPDPGPGGGHRQQWRRQAGAGEHCCPVILP

SEQ ID NO: 55 - protein, 1321 aa, Xanthomonas campestris
MDPIRSRTPSPARELLSGPQPDGVQPTADRGVSPPAGGPLDGLPARRTMSRTRLPSPPAPSPAFSADSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNNGGKQALETVQRLLPVLCQAPHDLTPEQVVAIASIGGGKQALETVQRLLPVLCQAPHDLTPEQVVAIASNGGGKQALETVQRLLPVLCQAPHCLTPEQVVAIASNIGGKQALETVQALLPVLCQAPHCLTPEQVVAIASNGGGKQALETVQRLLPVLCQAPHDLTPEQVVAIASNGGGKQALETVQRLLPVLCQAPHDLTPEQVVAIASHDGGKQALETVQRLLPVLCQAPHDLTPQQVVAIASNGGGKQALETVQRLLPVLCQAPHDLTPEQVVAIASHDGGKQALETVQRLLPVLCQAPHDLTPEQVVAIASNIGGKQALETVQALLPVLCQAPHCLTPEQVVAIASHDGGKQALETVQALLPVLCQAPHDLTPEQVVAIASNIGGKQALETVQRLLPVLCQAPHDLTREQVVAIASHDGGKQALETVQRLLPVLCQAPHDLTPEQVVAIASNGGGKQALETVQRLLPVLCQAPHDLTPEQVVAIASHDGGKQALETVQRLLPVLCQAPHDLTPEQVVAIASNGGGKQALETVQRLLPVLCQAPHDLTPEQVVAIASHDGGKQALETVQRLLPVLCQAPHDLTPEQVVAIASHDGGKQALETVQRLLPVLCQAPHDLTPEQVVAIASNGGGKQALETVQRLLPVLCQAPHDLTPEQVVAIASNGGGKQALETVQALLPVLCQAPHDLTPEQVVAIASNIGGKQALETVQRLLPVLCQAPHDLTPEQVVAIASNGGGKQALESIFAQLSRPDPALAALTNDRLVALACIGGRSALNAVKDGLPNALTLIRRANSRIPERTSHLVADHTQVVRVLGFFQCHSHPAQAFDEAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLLSWGVKRPRTRIGGLLDPGTPMDADLVASSTVVWEQDADPFAGTADDFPAFNEEELAWLMELLPH

SEQ ID NO: 56 - protein, 960 aa, Xanthomonas campestris
MDPIRSRTPSPARELLSGPQPDGVQPTADRGVSPPAGGPLDGLPARRTMSRTRLPSPPAPSPAFSADSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPQQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASHDGGKQALETVQRLLPVLCQAHGLTPQQVVAIASHDGGKQALETVQRLLPVLCQAHGLTPQQVVAIASNSGGKQALETVQRLLPVLCQAHGLTPQQVVAIASNSGGKQALETVQRLLPVLCQAHGLTPQQVVAIASNSGGKQALETVQRLLPVLCQAHGLTPEQVVAIASHDGGKQALETVQRLLPVLCQAHGLTPEQVVAIASNIGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLLSWGVKRPRTRIGGLLDPGTPMDADLVASSTVVWEQDADPFAGTADDFPAFNEEELAWLMELLPQ

SEQ ID NO: 57 - protein, 1062 aa, Xanthomonas campestris
MDPIRSRTPSPARELLSGPQPDGVQPTADRGVSPPAGGPLDGLPARRTMSRTRLPSPPAPSPAFSADSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNSGGKQALETVQALLPVLCQAHGLTPQQVVAIASNSGGKQALETVQALLPVLCQAHGLTPEQVVAIASNIGGKQALETVQRLLPVLCQAHGLTPQQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNSGGKQALETVQALLPVLCQAHGLTPEQVVAIASNIGGKQALETVQRLLPVLCQAHGLTPEQVVAIASNGGGKQALETVQRLLPVLCQAHGLTPEQVVAIASNIGGKQALETVQALLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 58 - protein, 1085 aa, Xanthomonas oryzae
DLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVKAVHAWRNALTGAPLNLTPAQVVAIASHDGGNQALETVQRLLPVLCQDHGLTPAQVVAIASHDGGKQALETVQRLLPVLCQDHGLTPDQVVAIASHDGGKQALETVQRLLPVLCQDHGLTPAQAVAIASNGGGKQALETVQRLLPVLCQDHGLTPDQVVAIASNGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGKQALETVQRLLPVLCQDHGLTLAQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPAQVVAIASHIGGKQALETVQRLLPVLCQDHGLTLDQVVAIASNDGSKQALETVQRLLPVLCQDHGLTPDQVVAIASHDGGKQALETVQRLLPVLCQDHGLTPNQVVAIASNIGGKQALETVQRLLPVLCQAHGLTPDQVVAIASHDGGKQALETVQRLLPVLCQNHGLTPDQVVAIASNGGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTELEARCGTLPPASQRWDRILQASGMKRAKPSPTSAQTPDQASLHAFADSLERDLDAPSPMHEGDQTRASNRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 59 - protein, 1136 aa, Xanthomonas oryzae
MDPIRSRTPSPARELLPGPQPDRVQPTADRGGAPPAGGPLDGLPARRTMSRTRLPSPPAPSPAFSAGSFNDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKSKVRSTVAQHHEALVGHGFTHAHIVALSQHPAALGTVAVKYQHIITALPEATHEDIVGVGKQWSGARALEALLTKAGELRGPPLQLDTGQLLKIAKRGGVTAVEAVHASRNALTGAPLNLTPDQVVAIASNIGGNQALETVQRLLPVLCQDHGLTPDQVVAIANNNGGKQALETVQRLLPVLCQAHGLTPDQVVAIASNGGKQALETVQRLLPVLCQAHGLTPNQVVAIASNGGGKQALETVQRLLPVLCQAHGLTQDQVVAIASNSGGKQALETVQRLLPVLCQAHGLTPAQVVAIASNNGGKQALETVQRLFPVLCQDHGLTPDQVVTIANNNGGKQALETVQRLLPVLCQAHGLIPDQVVAIANNNGGKQALETVQRLLPVLCQAHGLTPAQVVAIASNIGGKQALETVQRLLPVLCRAHGLTPAQVVAIANNNGGKQALETVQRLLPVLCQAHGLTPDQVVAIASNIGGKQALETVQRLLPVLCQDHGLTPDQVVAIASNGGKQALETVQRLLPVLCQDHGLTPAQVVAIASHDGGKQALETVQRLLPVLCQDHGLTLDQVVAIASHDGGKQALETVQRLLPVLCQDHGLTLDQVVAIASNIGGKQALETVQRLLPVLCQDHGLTPDQVVAIASNGGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 60 - protein, 1002 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKMKPKVRSTVAQHHEALVGHGFTHAHIVALSQHPAALGTVAVTYQDIIRALPEATHEDIVGVGKQWSGARTLEALLTEAGELRGPPLQLDTGQLLKIAKRGGVTAVEAVHAWRNALTGAPLNLTPDQVVAIASNIGGKQALETVQRLLPVLCQDHGLTPDQVVAIASNNGGKQALETVQRLLPVLCQAHGLTPDQVVAIASNIGGKQALETVQRLLPVLCQDHGLTPDQVVAIASHGGGKQALETVQRLLPVLCQDHGLTPDQVVAIASHGGGKQALETVQRLLPVLCQDHGLTPDQVVAIANNVGGKQALATVQRLLPVLCQDHGLTPDQVVAIASHGGGKQALETVQRLLPVLCQDHGLTPDQVVAIASHDGGKQALETVQRLLPVLCQDHGLTPDQVVAIASHGGGKQALETVQRLLPVLCQDHGLTPDQVVAIASHDGGKQALETVQRLLPVLCQDHGLTLDQVVAIASHDGGKKALETVQRLLPVLCQDHGLTPDQVVAIASHDGGKQALETVQRLLPVLCQDHGLTPDQVVAIASNGGGKQALESIVAQLSRPDPALAALTNDHLVALACLGGRPALDAVKKGLPHAPELIRRVNSRIGERTSHRVADYAQVVRVLEFFQCHSHPAYAFDEAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 61 - protein, 1375 aa, Xanthomonas oryzae
MDPIRSRTPSPARELLPGPQPDRVQPTADRGGAPPAGGPLDGLPARRTMSRTRLPSPPAPSPAFSAGSFSDPLRQFDPSLLDTSLFDSMPAVGTPHTAAAPAEWDEAQSALRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLTDAGELRGPPLQLDTGQLLKIAKRGGVTAVEAVHASRNALTGAPLNLTPAQVVAIASNNGGKQALETVQRLLPVLCQAHGLTPAQVVAIASHDGGKQALETVQRLLPVLCQDHGLTPDQVVAIASNSGGKQALETVQRLLPVLCQDHGLTPDQVVAIASNGGGKQALETVQRLLPVLCQDHGLTPDQVVAIASHDGGKQALETVQRLLPVLCQDHGLTPDQLVAIANNNGGKQALETVQRLLPVLCQDHGLTPDQVVAIASNGGKQALETVQRLLPVLCQDHGLTPDQVVAIASNIGGKQALETVQRLLPVLCQAHGLTPAQVVAIASHDGGKQALETMQRLLPVLCRAHGLTPAQVVAIASNSGGKQALETVQRLLPVLCQAHGLTPAQVVAIVSHDGGKQALETVQRLLPVLCQAHGLTPDQVVAIASNNGGKQALETVQRLLPVLCQDHGLTPDQVVAIASHDGGKQALGTVQRLLPVLCQDHGLTPDQVVAIASNNGGKQALETVQRLLPVLCQDHGLTPDQVVAIASHDGGKQALETVQRLLPVLCQAHGLTPAQVVAIASNNGGKQALETVQRLLPVLCQDHGLTPDQVVAIANNNGGKQALETVQRLLPVLCQAHGLTPAQVVAIASNNGSKQALETVQRLLPVLCQAHGLTPAQVVAIASNNGGKQALETVQRLLPVLCQAHGLTPDQVVAIASNNGGKQALETVQRLLPVLCQAHGLTPDQVVAIASNNGGKQALETVQRLLPVLCQAHGLTPDQVVAIASNNGGKQALETVQRLLPVLCQDHGLTPAQVVAIASHDGGKQALETVQRLLPVLCQDHGLTPAQVVAIASNGGGKQALESIVAQLSRPDPALAALTNDHLVALACLGGRPALDAVKKGLPHAPELIRRVNSRIGERTSHRVADYAQVVRVLEFFQCHSHPAYAFDEAMTQFGMSRNGLLQLFRRVGVTELEARGGTLPPASQRWDRILQASGMKRAKPSCASAQTPDQASLHAFADSLERDLDAPSPMHEGDQTRASSRKRSRSDRAVTGPSAQQSFEVRVPEQRDALHLPLSWRVKRPRTRIGGGLPDPGTPMAADLAASSTVMWEQDAAPFAGAADDFPAFNEEELAWLMELLPQSGSVGGTI

SEQ ID NO: 62 - protein, 1250 aa, Xanthomonas oryzae
MDPIRSRTPSPARELLPGPQPDRIQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEARELRGPPLQLDTGQLLKIAKRGGVTAVEAVHAWRNALTGAPLNLTPDQVVAIASNIGGKQALETVQRLLPVLCQDHGLTPDQVVAIARNGGGKQALETVQRLLPVLCQDHGLTPDQVVAIASNIGGKQALETVQRLLPVLCQDHGLTPDQVVAIASNIGGKQALATVQRLLPVLCQAHGLTPDQVVAIASNGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGKQALETVQRLLPVLCQDHGLTLAQVVAIASNIGGKQALETVQRLLPVLCQDHGLTPDQVVAIASNIGGKQALETVQRLLPVLCQDHGLTPDQVVAIASNIGGKQALETVQRLLPVLCQAHGLTPDQVVAIASNGGGKQALETVQRLLPVLCQDHGLTPDQVVAIASHDGGKQALETVQRLLPVLCQDHGLTPDQVVAIASHGGGKQALETVQRLLPVLCQDHGLTPDQVVAIANNNGGKQALETVQRLLPVLCQDHGLTPAQVVAIASNSGGKQALETVQRLLPVLCQDHGLTPDQVVAIANNNGGKQALEMVQRLLPVLCQDHGLTPDQVVAIASHDGGKQALETVQRLLPVLCQDHGLTLDQVVAIASHDGGKQALETVQRLLPVLCQDHGLTPDQVVAIASNGGGKQALETVQRLLPVLCQDHGLTPAQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDP

SEQ ID NO: 63 - protein, 1285 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDISLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEARELRGPPLQLDTGQLLKIAKRGGVTAVEAVHAWRNALTGAPLNLTPDQVVAIASNIGGNQALETVQRLLPVLCQDHGLTPDQVVAIASHGGKQALETVQRLLPVLCQDHGLTPDQVVAIASNIGGKQALETVQRLLPVLCQDHGLTPAQVVAIASNNGGKQALETVQRLLPVLCQAHGLTPDQVVAIASNNGGKQALETVQRLLPVLCQAHGLTPDQVVAIANNNGGKQALETVQRLLPVLCQDHGLSPDQVVAIANNNGGKQALETLQRLLPVLCQTHALTPDQVVAIANNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPAQVVAIASHGGGKQALETVQRLLPVLCQAHGLTPDQVVAIASHDGGKQALETVQRLLPVLCQAHGLTPNQVVAIASNIGGKQALETVQRLLPVLCQDHGLTPDQVVAIASNGGKQALETVQRLLPVLCQAHGLTPDQVVAIASNSGGKQALETVQRLLPVLCQDHGLTPNQVVAIASNIGGKQALETVQRLLPVLCQDHGLTPDQVVAIASNIGGKQALETVQRLLPVLCQDHGLTLDQVVAIASHGGGKQALETVQRLLPVLCQDHGLTSDQVVAIASHDGGKQALETVQRLLPVLCQDHGLTPDQVVAIASNSGGKQALETVQRLLPVLCQDHGLTPAQVVAIASNSGGKQALETVQRLLPVLCQAHGLTPNQVVAIASNGGGKQALESIVAQLSRPDPALAALTNDHLVALACLGGRPALDAVKKGLPHAPNLIRRVNSRIGERTSHRVADLAQVVRVLEFFQCHSHPAHAFDEAMTQFGMSRNGLLQLFRRVGVTELEARGGTLPPASQRWDRILQASGMKRAKPSPTSAQTPDQASLHAFADSLERDLDALSPMHEGDQTRASSRKRSRSDRAVTGPSAQQSFEVRVPEQHDALHLPLSWRVKRPRTRIGGGLPDP

SEQ ID NO: 64 - protein, 1002 aa, Xanthomonas oryzae
MDPIRSRTPSPARELLPGPQPDRVQPTADRGGAPPAGGPLDGLPARRTMSRTRLPSPPAPSPAFSAGSFSDPLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKMKPKVRSTVAQHHEALVGHGFTHAHIVALSQHPAALGTVAVTYQDIIRALPEATHEDIVGVGKQWSGARTLEALLTEAGELRGPPLQLDTGQLLKIAKRGGVTAVEAVHAWRNALTGAPLNLTPDQVVAIASNIGGKQALETVQRLLPVLCQDHGLTPDQVVAIASNNGGKQALETVQRLLPVLCQDHGLTPDQVVAIASNIGGKQALETVQRLLPVLCQDHGLTPDQVVAIASHGGGKQALETVQRLLPVLCQDHGLTPDQVVAIASHGGGKQALETVQRLLPVLCQDHGLTPDQVVAIANNVGGKQALETVQRLLPVLCQDHGLTPDQVVAIASHGGGKQALETVQRLLPVLCQDHGLTPDQVVAIASHDGGKQALETVQRLLPVLCQDHGLTPDQVVAIASHGGGKQALETVQRLLPVLCQDHGLTPDQVVAIASHDGGKQALETVQRLLPVLCQDHGLTLDQVVAIASHDGGKKALETVQRLLPVLCQDHGLTPDQVVAIASHDGGKQALETVQRLLPVLCQDHGLTPDQVVAIASNGGGKQALESIVAQLSRPDPALAALTNDHLVALACLGGRPALDAVKKGLPHAPELIRRVNSRIGERTSHRVADYAQVVRVLEFFQCHSHPAYAFDEAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 65 - protein, 1136 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKSKVRSTVAQHHEALVGHGFTHAHIVALSQHPAALGTVAVKYQHIITALPEATHEDIVGVGKQWSGARALEALLTKAGELRGPPLQLDTGQLLKIAKRGGVTAVEAVHASRNALTGAPLNLTPDQVVAIASNIGGNQALETVQRLLPVLCQDHGLTPDQVVAIANNNGGKQALETVQRLLPVLCQAHGLTPDQVVAIASNGGKQALETVQRLLPVLCQAHGLTPNQVVAIASNGGGKQALETVQRLLPVLCQAHGLTQDQVVAIASNSGGKQALETVQRLLPVLCQAHGLTPAQVVAIASNNGGKQALETVQRLFPVLCQDHGLTPDQVVTIANNNGGKQALETVQRLLPVLCQAHGLIPDQVVAIANNNGGKQALETVQRLLPVLCQAHGLTPAQVVAIASNIGGKQALETVQRLLPVLCRAHGLTPAQVVAIANNNGGKQALETVQRLLPVLCQAHGLTPDQVVAIASNIGGKQALETVQRLLPVLCQDHGLTPDQVVAIASNGGKQALETVQRLLPVLCQDHGLTPAQVVAIASHDGGKQALETVQRLLPVLCQDHGLTPDQVVAIASHDGGKQALETVQRLLPVLCQDHGLTLDQVVAIASNIGGKQALETVQRLLPVLCQDHGLTPDQVVAIASNGGGKQALETVQRLLPVLCQDHGLTPDQVVAIASNGGGKQALESIVAQLSRPDPALAALTNDHLVALACLGGRPALDAVKKGLPHAPELIRRVNSRIGERTSHRVADYAQVVRVLEFFQCHSHPAYAFDEAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 66 - protein, 1482 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALFTKAGELRGPPLQLDTGQLLKIAKRGGVTAVEAVHASRNALTGAPLNLTPDQVVAIASHDGGKQALETVQRLLPVLCQAHGLTPAQVVAIASHDGGKQALETVQRLLPVLCQAHGLTPAQVVAIASNNGGKQALETVQRLLPVLCQAHGLTPDQVVAIASNNGGKQALETVQRLLPVLCQAHGLTPDQVVAIASNSGGKQALETVQRLLPVLCQAHGLTPDQVVAIASNGGGKQALETVQRLLPVLCQAHGLTPDQVVAIASHDGGKQALETVQRLLPVLCQAHGLTPAQVVAIASSGGKQALETVQRLLPVLCQDHGLTPDQVVAIASHGGSKQALETVQRLLPVLCQAHGLTPDQVVAIASHDGGKQALETVQRLLPVLCQAHGLTPAQAVAIASNGGGKQALETVQRLLPVLCQAHGLTPDQVVAIASNGGKQALETVQRLLPVLCQDHGLTPDQVVAIASHDGGKQALATVQRLLPVLCQAHGLTPDQVVAIASHDGGKQALETVQRLLPVLCQDHGLTPDQVVAIASHDGGKQALETVQRLLPVLCQDHGLTPDQVVAIASNGGKQALETVQRLLPVLCQDHGLTPDQVVAIANNNGGKQALETVQRLLPVLCQDHGLTPDQVVAIASNQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPAQVVAIASHIGGKQALETVQRLLPVLCQDHGLTLDQVVAIASNDGSKQALETVQRLLPVLCQDHGLTPDQVVAIASHDGGKQALETVQRLLPVLCQDHGLTPDQVVAIASHGGGKQALETVQRLLPVLCQDHGLTSAQVVAIANNNGGKQALETVQRLLPVLCQDHGLTPDQVVAIASHGGGKQALETVQRLLPVLCQDHGLTPDQVVAIASNGGKQALESIVAQLSRPDPALAALTNDHLVALACLGGRPALDAVKKGLPHAPELIRRINRRIPERTSHHVPDLAHVVRVLGFFQSHSHPAQAFDDAMTQFGMSRNGLVQLFRRVGVTELEARGGTLPPASQRWDRILQASGMKRAKPSPTSAQTPDQASLHAFADSLERDLDAPSPMHEGDQTGASSRKRSRSDRAVTGPSAQHSFEVRVPEQHDALHLPLSWRVKRPRTRIGGGLPDPGTPIAADLAASSTVLWEQDAAPFAGAADDFPAFNEEELAWLMELLPQSGSVGGTI

SEQ ID NO: 67 - protein, 1238 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEAQSGLRAADDPPPTVRVAVTAARPPRAKPAPRRRAAQPSDASPAAQVDLRTLGYSQQQQEKIKPKVRSTVARHHEALVGHGFTHAHIVALSQHPAALGTVAVTYQDIIRALPEATHEDIVGVGKQWSGARALEALLTEAGELRGPPLQLDTGQLLKIAKRGGVTAVKAVHAWRNALTGAPLNLTPAQVVAIASHDGGNQALETVQRLLPVLCQDHGLTPDQVVAIASHDGGKQALETVQRLLPVLCQDHGLTPDQVVAIASHDGGKQALETVQRLLPVLCQDHGLTPAQAVAIASNGGGKQALETVQRLLPVLCQDHGLTPDQVVAIASNGGKQALETVQRLLPVLCQAHGLTPDQVVAIASNGGGKQALETVQRLLPVLCQAHGLTPDQVVAIASHDGGKQALETVQRLLPVLCQAHGLTPAQVVAIASSGGKQALETVQRLLPVLCQDHGLTPDQVVAIASHGGSKQALETVQRLLPVLCQAHGLTLAQVVAIASNIGGKQALETVQRLLPVLCQAHGLTPAQVMAIASNIGGKQALETVQRLLPVLCQDHGLTPDQVVAIASNNGGKQALETLQRLLPVLCQDHGLTPDQVVAIASHDGGKQALETVQRLLPVLCQDHGLTPDQVVAIASNNGGKQALETLQRLLPVLCQDHGLTLDQVVAIASNDGSKQALETVQRLLPVLCQDHGLTPDQVVAIASHDGGKQALETVQRLLPVLCQDHGLTPNQVVAIASNIGGKQALETVQRLLLVLCQDHGLTPAQVVAIASHDGGKQALETVQRLLPVLCQDHGLTPDQVVAIASHGGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADLAHVVRVLGFFQSHSHPAQAFDDAMTQFGMSRNGLVQLFRRVGVTELEARCGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRQRTRIGGGLPDPGTPIAADLAASSTVMWEQDAAPFAGAADDFPAFNEEELAWLMELLPQSGSVGGTI

SEQ ID NO: 68 - protein, 1171 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTKAGELRGPPLQLDTGQLLKIAKRGGVTAVEAVHAWRNALTGAPLNLTPDQVVAIASNIGGKQALETVQRLLPVLCQAHGLNPDQVVAIASNSGGKQALETVQRLLPVLCQDHGLTPDQVVAIASHDGGKQALETVQRLLPVLCQDHGLTPDQVVAIASNGGGKQALETVQRLLPVLCQAHGLNPDQVVAIASNSGGKQALETVQRLLPVLCQAHGLNPDQVVAIASNNGGKQALETVQRLLPVLCQDHGLSPDQVVAIASHDGGKQALETVQRLLPVLCQDHGLTPDQVVAIASNGGKQALETVQRLLPVLCQDHGLTPDQVVAIANNNGGKQALETVQRLLPVLCQDHGLTPDQVVAIANNNGGKQALETVQRLLPVLCQAHGLPPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLSPDQVVAIASHDGGKQALETVQRLLPVLCQDHGLTLDQVVAIASHDGGKQALETVQRLLPVLCQAHGLTPDQVVAIASHDGGKQALETVQRLLPVLCQDHGLTPDQVVAIASNGGGKQALESIVAQLYRPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPIAADLAASSTVMWEQNADPFAGAADDFPAFNEEELAWLMELLPQSGSVGGTI

SEQ ID NO: 69 - protein, 1240 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVEAVHAWRNALTGAPLNLTPDQVVAIASNIGGNQALETVQRLLPVLCQAHGLTPDQVVAIASHGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIANNNGGKQALETVQRLLPVLCQDHGLTPDQVVAIASHDGGKQALETVQRLLPVLCQGHGLTPDKVVAIASNSGGKQALETVQRLLPVLCQAHGLTPDKVVAIANNNGGKQALETVQRLLPVLCQDHGLTPDQVVAIASNSGGKQALETVQRLLPVLCQDHGLTPAQVVAIANNNGGKQALETVRRLLPVLCQDHGLTPDQVVAIASHDGGKQALETVQRLLPVLCQDHGLTPDQVVAIANNNGGKQALETVQRLLPVLCQDHGLTQDQVVAIASNIGGKQALETVQRLLPVLCQDHGLTPDQVVAIASHDGGKQALETVQRLLPVLCQDHGLTPAQVVAIANNNGGKQALETVQRLLPVLCQDHGLSPDQVVAIASNIGGKQALETVQRLLPVLCQDHGLTPDQVVAIASNGGGKQALETVQRLLPVLCQDHGLSPDQVVAIASHDGGKQALETVQRLLPVLCQDHGLTPDQVVAIASNGGGKQALESIVAQLSRPDPALAALTNDHLVALACLGGRPAMDAVKKGLPHAPELIRRVNSRIGERTSHRVADYAQVVRVLEFFQCHSHPAYAFDEAMTQFGMSRNGLVQLFRRVGVTELEARCGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 70 - protein, 1375 aa, Xanthomonas oryzae
MDPIRSRTPSPARELLPGPQPDRVQPTADRGGAPPAGGPLDGLPARRTMSRTRLPSPPAPSPAFSAGSFSDPLRQFDPSLLDTSLFDSMPAVGTPHTAAAPAEWDEAQSALRAADDPPPTVRVAVTAARPPRAKPAPRRRAAQPSDASPAAQVDLRTLGYSQQQQEKIKPKVRSTVAQHHEALVGHGFTHAHIVALSKHPAALGTVAVTYQHIITALPEATHEDIVGVGKQWSGARALEALLTDAGELRGPPLQLDTGQLLKIAKRGGVTAVEAVHASRNALTGAPLNLTPAQVVAIASNNGGKQALETVQRLLPVLCQAHGLTPAQVVAIASHDGGKQALETVQRLLPVLCQDHGLTPDQVVAIASNSGGKQALETVQRLLPVLCQDHGLTPDQVVAIASNGGGKQALETVQRLLPVLCQDHGLTPDQVVAIASHDGGKQALETVQRLLPVLCQDHGLTPDQLVAIANNNGGKQALETVQRLLPVLCQDHGLTPDQVVAIASNGGKQALETVQRLLPVLCQDHGLTPDQVVAIASNIGGKQALETVQRLLPVLCQAHGLTPAQVVAIASHDGGKQALETMQRLLPVLCQAHGLTPAQVVAIASNSGGKQALETVQRLLPVLCQDHGLTPAQVVAIVSHDGGKQALETVQRLLPVLCQAHGLTPDQVVAIASNNGGKQALETVQRLLPVLCQDHGLTPDQVVAIASHDGGKQALGTVQRLLPVLCQDHGLTPDQVVAIASNNGGKQALETVQRLLPVLCQDHGLTPDQVVAIASHDGGKQALETVQRLLPVLCQAHGLTPAQVVAIASNNGGKQALETVQRLLPVLCQDHGLTPDQVVAIANNNGGKQALETVQRLLPVLCQAHGLTPAQVVAIASNNGSKQALETVQRLLPVLCQAHGLTPAQVVAIASNNGGKQALETVQRLLPVLCQAHGLTPDQVVAIASNNGGKQALETVQRLLPVLCQAHGLTPDQVVAIASNNGGKQALETVQRLLPVLCQAHGLTPDQVVAIASNNGGKQALETVQRLLPVLCQDHGLTPDQVVAIASHDGGKQALETVQRLLPVLCQDHGLTPAQVVAIASNGGGKQALESIVAQLSRPDPALAALTNDHLVALACLGGRPALDAVKKGLPHAPELIRRVNSRIGERTSHRVADYAQVVRVLEFFQCHSHPAYAFDEAMTQFGMSRNGLLQLFRRVGVTELEARGGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPMAADLAASSTVMWEQDAAPFAGAADDFPAFNEEELAWLMELLPQSGSVGGTI

SEQ ID NO: 71 - protein, 1284 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEAQSGLRAADDPPPTVRVAVTAARPPRAKPAPRRRAAQPSDASPAAQVDLRTLGYSQQQQEKIKPKVRSTVARHHEALVGHGFTHAHIVALSQHPAALGTVAVTYQDIIRALPEATHEDIVGVGKQWSGARALEALLTEARELRGPPLQLDTGQLLKIAKRGGVTAVEAVHAWRNALTGAPLNLTPDQVVAIASNIGGKQALETVQRLLPVLCQDHGLTPDQVVAIASNGGKQALETVQRLLPVLCQAHGLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQDHGLIPDQVVAIASNIGGKQALETVQRLLPVLCQDHGLTPDQVVAIASNSGGKQALETVQRLLPVLCQAHGLTPDQVVAIASHDGGKQALETVQRLLPVLCQDHGLTPAQVVAIASNNGGKQALETVQRLLPVLCQAHGLTPDQVVAIASHDGGKQALETVQRLLPVLCQDHGLTPAQVVAIASNSGGKQALETVQRLLPVLCQDHGLTPDQVVAIASNGGGKQALETVQRLLPVLCQDHGLTPDQVVAIASSSGGKQALETVQRLLPVLCQAHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIANNNGGKQALETVQRLLPVLCQDHGLTPDQVVAIASNIGGKQALETVQRLLPVLCQDHGLTPAQVVAIANNNGGKQALETVQRLLPVLCQDHGLTPDQVVAIASNSGGKQALETVQRLLPVLCQDHGLTPDQVVAIASNGGGKQALESIVAQLSRPDPALAALTNDHLVALACLGGRPALDAVKKGLPHAPELIKRINRRIPERTSHRVADLPERTSHRVADLAHVVRVLGFFQSHSHPAQAFDDAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQHDALHLPLSWRVKRPRTRIGGGLPDPGTPIAADLAASSTVMWEQDAAPFAGAADDFPAFNEEELAWLMELLPQSGSVGGTI

SEQ ID NO: 72 - protein, 1099 aa, Xanthomonas oryzae
MDPIRSRTPSPARELLPGPQPDRVQPTADRGGAPPAGGPLDGLPARRTMSRTRLPSPPAPSPAFPAGSFSDLLRQVDTSLLDSMPAVGTPHTAAAPAEWDEMQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTKAGELRGPPLQLDTGQLLKIAKRGGVTAVEAVHAWRNALTGAPLNLTPDQVVAIASNIGGKQALETVQRLLPVLCQAHGLTPDQVVAIANNNGGKQALETVQRLLPVLCQAHGLTPAQVVAIASNNGGKQALETVQRLLPVLCQDHGLTPDQVVAIASNIGGKQALETVQRLLPVLCQDHGLTPDQVVAIASNIGGKQALETVQRLLPVLCQTHALTPDQVVAIASNIGGKQALETVQRLLPVLCQDHGLTPAQVVAIASHDGGKQALETVQRLLPVLCQDHGLTPDQVVAIASNSGGKQALETVQRLLPVLCQAHGLTLDQVVAIASHGGGKQALETVQRLLPVLCQDHGLTPDQVVAIASNNGGKQALETVQRLLPVLCQDHGLIPDQVVAIANNNGGKQALETVQRLLPVLCQAHGLTTDQVVTIASNNGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNGGGKQALETVQRLLPVLCQDHGLTPDQVVAIASHDGGKQALESIVAQLSRPDPALAALTNDHLVALACLGGRPALDAVKKGLPHAPELIRRINRRIPERTSHRVADYAQVVRVLEFFQCHSHPAYAFDEAMTQFGMSRNGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 73 - protein, 1237 aa, Xanthomonas oryzae
MDPIRSRTPSPARELLPGPQPDRVQPTADRGGTPPAGGPLDGLPVRRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEARELRGPPLQLDTGQLLKIAKRGGVTAVEAVHAWRNALTGAPLNLTPDQVVAIASNIGGNQALETVQRLLPVLCQAHGLTPDQVVAIASNGGKQALETVQRLLPVLCQDHSLTPDQVVAIASNIGGKQALETVQRLLPVLCQDHGLTPDQVVAIASNSGGKQALETVQRLLPVLCQDHGLTPDQVMTIASNNGGKQALETVQRLLPVLCQDHGLTPDQVVTIASNGGGKQALETVQRLLPVLCQAHGLTPDQVVAIANNNGGKQALETVQRLLPVLCQAHGLTPAQVVAIASNSGGKQALETVQRLLPVLCQAHGLTPDQVVAIASNGGKQALETVQRLLPVLCQAHGLTPDQVVAIASNSGGKQALETVQRLLPVLCQAHGLTPDQVVAIANNNGGKQALETVQRLLPVLCQAHGLTPDQVVAIASNSGGKQALETVQRLLPVLCQDHGLTPDQVVAIASNGGKQALETVQRLLPVLCQDHGLTPDQVVAIASHDGGKQALETVQRLLPVLCQDHGLTLDQVVAIASHGGGKQALETVQRLLPVLCQDHGLTSDQVVAIASHDGGKQALETVQRLLPVLCQDHGLTPDQVVAIASNIGGKQALETVQRLLPVLCQDHGLTLDQVVAIASHDGGKQALETVQRLLPVLCQDHGLTPDQVVAIASHDGGKQALETVQRLLPVLCQDHGLTPAQVVAIASNGGGKQALESIVAQLSRPDPALAALTNDHLVALACLGGRPALDAVKKGLPHAPELIRRINRRIPERTSHRVADYAQVVRVLEFFQCHSHPAYAFDEAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 74 - protein, 1611 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSIPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTKAGELRGPPLQLDTGQLLKIAKRGGVTAVEAVHAWRNALTGAPLNLTPDQVVAIASNIGGNQALETVQRLLPVLCQAHGLTPDQVVAIASHGGGKQALETLQRLLPVLCQDHGLTPDQVVAIASNIGGKQALETVQRLLPVLCQDHGLTPDQVVAIASNGGGKQALETLQRLLPVLCQAHGLTPDQVLAIASHGGGKQALETLQRLLPVLCQDHGLTPAQVVALASHDGGKQALETVQRLLPVLCQDHGLTPAQVVAIASNSGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIANNNGGKQALETVQRLLLVLCQAHGLTPDQVVAIASNGGGKQALETVQRLLPVLCQDHGLTPDQVVAIASHGGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHGGGKQALETVQRLLPVLCQDHGLTPDQVVAIASHDGGKQALETVQRLLPVLCQDHGLTPDQVVAIASHDGGKQALETVQRLLPVLCQDHGLTLDQVVAIASNIGGKQALETVQRLLPVLCQDHGLTPDQVVAIASNSGGKQALETVQRLLPVLCQDHGLTPDQVVAIASHGGGKQALETVQRLLPVLCQDHGLTPDQVVAIASHDGGKQALETVQRLLPVLCQAHGLTPNQVVAIASNIGGKQALETVQRLLPVLCQDHGLTPDQVVAIASNGGKQALETVQRLLPVLCQAHGLTPDQVVAIASNSGGKQALETVQRLLPVLCQDHGLTPNQVVAIASNIGGKQALETVQRLLPVLCQDHGLTPDQVVAIASNIGGKQALETVQRLLPVLCQDHGLTLDQVVAIASHDGGKQALETVQRLLPVLCQAHGLTPDQVVAIASHDGGKQALETVQRLLPVLCQAHGLTLDKVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 75 - protein, 863 aa, Xanthomonas oryzae
MDPIRSRTPSPAREPLPGPQPDRVQPTADRGVSAPAGSPLDGLPARRTVSRTRLPSPPAPLPAFSAGSSTDRLRPFDPSLPDTSLFDSMPAVGTPHTEAAPADTSPAAQVDLLTLATVAQHHEALVGHGFTHAHIVALSQHPAALGTVAVTYQDIITALPEATHEDIVGVGKQLSGARALEALLTKAGELRGPPLQLDTGQLLKIARRGGVTAVEAVHAWRNALTGAPLNLTPDQVVAIASNSGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVLCQAHGLTPAQVVAIASNGGGKQALETVQRLLPVLCQAHGLTLDQVVAIASNGGGKQALETVQRLLPVLCQAHGLTPDQVVAIASHDGGKQALETVQRLLPVLCQAHGLTPAQVVAIASHDGGKQALETVQRLLPVLCQAHGLTLDQVVAIASHDGGKQALETVQRLLPVLCQAHGLTLDQVVAIASHDGGKQALETVQRLLPVLCQDHGLTPAQVVAIASNNGGKQALETVQRLLPVLCQDHGLTPDQVVAIASHDGGKQALETMQRLLPVLCQAHGLTPDQVVAIASNGGGKQALETVQRLLPVLCQAHGLTPDQVVAIASHDGGKQALETVQRLLPVLCQDHGLTPAQVVAIASHDGGKQALETVQRLLQVLCQDHGLTPDQVVAIASHDGGKQALETVQRLLPVLCQDHGLTPDQVVAIANNNGGKQALETVQRLLPVLCQDHGLTPDQVVAIASHGGKQALESIVAQLSRRDPALAALTNDQLVALACLGGRPAPHSRKRKSHD

SEQ ID NO: 76 - protein, 1646 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTEARELRGPPLQLDTGQLLKIAKRGGVTAVEAVHAWRNALTGAPLNLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNSGGKQALETVQRLLPVLCQDHGLTPDQVVAIASNGGKQALETVQRLLPVLCQAHGLTPDQVVAIANNNGGKQALETVQRLLPVLCQAHGLTPAQVVAIASNSGGKQALETVQRLLPVLCQAHGLTPDQVVAIASNGGKQALETVQRLLPVLCQAHGLTPDQVVAIASNSGGKQALETVQRLLPVLCQAHGLTPDQVVAIANNNGGKQALETVQRLLPVLCQAHGLTPDQVVAIASNIGGKQALETVQRLLPVLCQDHGLTPDQVVAIASNNGGKQALETVQRLLPVLCQAHGLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQDHGLIPDQVVAIASNIGGKQALETVQRLLPVLCQDHGLTPDQVVAIASNSGGKQALETVQRLLPVLCQAHGLTPDQVVAIASHDGGKQALETVQRLLPVLCQDHGLTPAQVVAIASNNGGKQALETVQRLLPVLCQAHGLTPDQVVAIASHDGGKQALETVQRLLPVLCQDHGLTPDKVVAIASNSGGKQALETVQRLLPVLCQDHGLTPDQVVAIASNSGGKQALETVQRLLPVLCQDHGLTPAQVVAIANNNGGKQALETVRRLLPVLCQDHGLTPDQVVAIASHDGGKQALETVQRLLPVLCQDHGLTPDQVVAIANNNGGKQALETVQRLLPVLCQDHGLTQDQVVAIASNNGGKQALETVQRLLPVLCQAHGLTPDQVVAIANNNGGKQALETVQRLLPVLCQDHGLSPDQVVAIANNNGGKQALETLQRLLPVLCQTHALTPDQVVAIANNNGGKQALETVQRLLPVLCQDHGLTLDQVVAIASHDGGKQALETVQRLLPVLCQDHGLTPDQVVAIASHDGGKQALETVQRLLPVLCQDHGLTPAQVVAIASNGGGKQALESIVAQLSRPDPALAALTNDHLVALACLGGRPALDAVKKGLPHAPELIRRINRRIPERTSHRVPDLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 77 - protein, 1239 aa, Xanthomonas oryzae
MDPIRSRTPSPARELLPGPQPDRVQPTADRGGAPPAGGPLDGLPARRTMSRTRLPSPPAPSPAFSAGSFNDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTEARELRGPPLQLDTGQLLKIAKRGGVTAVEAVHAWRNALTGAPLNLTPDQVVAIASNIGGKQALETVQRLLPVLCQDHGLTPDQVVAIASNGGGKQALETVQRLLPVLCQDHGLTPDQVVAIASNNGGKQALETVQRLLPVLCQDHGLTPDQVVAIASNGGGKQALETVQRLLPVLCQDHGLTPDQVVAIANNKGGKQALETLQRLLPVLCQAHGLTPDQVVAIASNGGGKQALETVQRLLPVLCQDHGLTPAQVVAIASNIGGKQALETVQRLLPVLCQDHGLTPDQVVAIANNNGGKQALETVQRLLPVLCQDHGLTPDQVVTIASNIGGKQALETVQRLLPVLCQDHGLTPDQVVAIANNNGGKQALETVQRLLPVLCQAHGLTPDQVVAIASNIGGKQTLETVQRLLPVLCQDHGLTPDQVVAIANNNGGKQALETVQRLLPVLCQDHGLTPDQVVAIASNSGGKQALETVQRLLPVLCQDHGLTPNQVVAIASNGGGKQALETVQRLLPVLCQDHGLTPDQVVGIASNSGGKQALETVQRLLPVLCQDHGLTPDQVVAIANNNGGKQALETVQRLLPVLCQDHGLTPDQVVAIASNIGGKQALETVQRLLPVLCQDHGLTLDKVVAIASNGGKQALETVQRLLPVLCQDHGLTPDQVVAIASNSGGKQALETVQRLLPVLCQDHGLTPDQVVAIASNGGGKQALESIVAQLSRPDPALAALTNDHLVALACLGGRPAMDAVKKGLPHAPELIRRVNRRIGERTSHRVADYAQVVRVLEFFQCHSHPAYAFDEAMTQFGMSRHGLVQLFRRVGVTELEARGGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 78 - protein, 1483 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTEAGELRGPPLQLDTGQLLKIAKRGGVTAVEAVHAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASHGGGKQALETVQRLLPVLCQAHGLTPDQVVAIARHDGGKQALETVQRLLPVLCQAHGLTPDQVVAIANNNGGKQALETVQRLLPVLCQAHGLTPDQVVAIASHDGGKQALETVQRLLPVLCQAHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIANNNGGKQALETVQRLLPVQRLVPVLCQDHGLTQDQVVAIASNIGGKQALETVQRLLPVLYQDHGLTQDQVVAIASHDGGKQALETVQRLLPVLCQDHGLTPDQVVAIASHDGGKQALETVQRLLPVLCQEHGLTPDQVVAIASHDGGKQALETVQRLLPVLCQDHGLTPDQVVAIASHGGGKQALGTVQRLLPVLCQDHGLTPDQVVAIANNNGGKQALETVQRLLPVLCQDHGLTPDQVVAIANNNGGKQALETVQRLLPVLCQAHGLTPDQVVAIASHDGGKQALETVQRLLPVLCQDHGLTPAQVVAIASNSGGKQALETVQRLLPVLCQDHGLTPAQVVAIANNNGGKQALETVQRLLPVLCQDHGLTPDQVVAIASHDGGKQALETVQRLLPVLCQDHGLTPDQVVAIASNGGGKQALATVQRLLPVLCQAHGLTPDQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTDPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 79 - protein, 1446 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTEARELRGPPLQLDTGQLLKIAKRGGVTAVEAVHAWRNALTGAPLNLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQAHGLTPDQVVAIASNIGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIANNNGGKQALETLQRLLPVLCQDHGLTPDQVVAIASHDGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASNSGGKQALETVQRLLPVLCQDHGLTPDQVVAIASNGGKQALETVQRLLPVLCQDHGLTPDQVVAIASNGGKQALETVQRLLPVQRLLPVLCQDHGLTQDQVVAIASHDGGKQALETVQRLLPVLCQDHGLTPDQVVAIASHDGGKQALETVQRLLPVLCQDHGLTPDQVVAIASNSGGKQALETVQRLLPVLCQDHGLTPDQVVAIASNSGGKQALETVQRLLPVLCQDHGLTPDQVVAIASNNGGKQALETVQRLLPVLCQDHGLTPDQVVAIANNNGGKQALETVQRLLPVLCQDHGLTPAQVVAIASNIGGKQALETVQRLLPVLCQDHGLTLDQVVAIASNGGSKQALETVQRLLPVLCQDHGLTPDQVVAIANNNGGKQALETVQRLLPVLCQDHGLTPDQVVAIASNIGGKQALETVQRLLPVLCQDHGLTLDQVVAIASNGGKQALETVQRLLPVLCQDHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 80 - protein, 1309 aa, Xanthomonas oryzae
MDPIRSRTPSPARELLPGPQPDRVQPTADRGGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTKAGELRGPPLQLDTGQLLKIAKRGGVTAVEAVHAWRNALTGAPLNLTPDQVVAIASNIGGKQALETVQRLLPVLCQAHGLTPDQVVAIASHGGGKQALETVQRLLPVLCQDHGLTPAQVVAIASNIGGKQALETVQRLLPVLCQDHGLTPDQVMAIANNNGGKQALETVQRLLPVLCQDHGLTPDQVMAIANNNGGKQALETVQRLLPVLCQDHGLTPDQVVAIASNIGGKQALETVQRLLPVLCQDHGLTPTQVMAIANNNGGKQALETVQRLLPVLCQDHGLTPDQVVAIASHDGGKQALETVQRLLPVLCQDHGLTPAQVVAIASNIGGKQALETVQRLLPVLCQDHGLTPDQVVAIASHDGGKQALETVQRLLPVLCQDHGLTPDQVVAIASNSGGKQALETVQRLLPVLCQDHGLTPDQVVAIASNSGGKQALETVQRLLPVLCQDHGLTPAQVVAIASNSGGKQALETVQRLLPVLCQDHGLTPDQVVAIASHDGGKQALETVQRLLPVLCQDHGLTPDQVVAIANNNGGKQALETLQRLLPVLCQDHGLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPAQVVAIASHDGGKQALETVQRLLPVLCQDHGLTPDQVVAIASHDGGKQALETVQRLLPVLCQDHGLTPDQVVAIASNGGGKQALKTVQRLLPVLCQDHGLTPDQVVAIASNGGGKQALESIVAQLSCPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTDPSAQQSFEVRVPEQHDTLHLPLSWRVKRPRTRIGGGLPDPGTPIAADLAASSTVMWEQDAAPFAGAADDFPAFNEEELAWLMELLPQSGSVGGTI

SEQ ID NO: 81 - protein, 647 aa, Xanthomonas oryzae
MRPGKLCRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEAQSGLRAADDPPPTVRVAVTAARPPRAKPAPRRRAAQPSDASPAAQVDLRTLGYSQQQQEKIKPKVRSTVARHHEALVGHGFTHAHIVALSQHPAGVTYQDIIRALPEATHEDIVGVGKQWSGARALEALLTEAGELRGPPLQLDTGQLLKIAKRGGVTAVKAVHAWRNALTGAPLNLTPAQVVAIASHDGGNQALETVQRLLPVLCQDHGLTPDQVVAIASNGGGKQALESIVAQLSRPDPALAALTNDHLVALACLGGRPALDAVKKGLPHAPELIRRVNRRIGERTSHRVADYAQVVRVLEFFQCHSHPAQAFDDAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPMVADLAASSTVMWEQDAAPFAGAADDFPAFNEEELAWLMELLPQSGSVGGTI

SEQ ID NO: 82 - protein, 652 aa, Xanthomonas oryzae
MRPGKLCRDHRPLVWRRPCKEVCLMDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEAQSGLRAADDPPPTVRVAVTAARPPRAKPAPRRRAAQPSDASPAAQVDLRTLGYSQQQQEKIKPKVRSTVARHHEALVGHGFTHAHIVALSQHPAALGTVAVTYQDIIRALPEATHEDIVGVGKQWSGARALEALLTEAGELRGPPLQLDTGQLLKIAKRGGVTAVKAVHAWRNALTGAPLNLTPAQVVAIASNIGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADYAQVVRVLEFFQCHSHPAYAFDEAMTQFGMSRNGLVQLFRRVGVTELEARGGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 83 - protein, 1060 aa, Xanthomonas axonopodis
MDPIRSRTPSPARELLPGPQPDGVQPTADRGVSPPAGGPLDGLPARRTISRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNGGGKQALETVQRLLPVLCQAHGLTPDQVVAIASNGGKQALETVQRLLPVLCQAHGLTPAQVVAIASNIGGKQALETVQRLLPVLCQAHGLTPAQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 84 - protein, 1096 aa, Xanthomonas smithii
MDPIRSRTPSPARELLPGPQPDGVQPTADRGVSPPAGGPLDGLPARRTISRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASNGGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASNIGGKQALETVQRLLPVLCQAHGLTPDQVVAIASNIGGKQALETVQRLLPVLCQAHGLTPEQVVAIASNIGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 85 - protein, 1163 aa, Xanthomonas smithii
MDPIRSRTPSPARELLPGPQPDGVQPTADRGVSPPAGGPLDGLPARRTISRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLCQAHGLTPEQVVAIASHDGGKQALETVQRLLPVLCQAHGLTPDQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTPAQVVAIASNGGGKQALETVQRLLPVLCQAHGLTPEQVVAIASNSGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIACNGGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 86 - protein, 1295 aa, Xanthomonas smithii
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVYAWRNALTGAPLNLTPEQVVAIASNIGGKQALETVQRLLPVLCQAHGLTPDQVVAIASNGGKQALETVQRLLPVLCQAHGLTPAQVVAIASNIGGKQALETVQRLLPVLCQAHGLTPAQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPAQVVAIASNGGKQALETVQRLLPVLCQAHGLTPDQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPVFNEEELAWLMELLPQ

SEQ ID NO: 87 - protein, 649 aa, Ralstonia solanacearum
  MOD_RES (246)..(385): Any amino acid
LTPQQVVAIASNTGGKRALEAVCVQLPVLRAAPYRLSTEQVVAIASNKGGKQALEAVKAHLLDLLGAPYVLDTEQVVAIASHNGGKQALEAVKADLLDLRGAPYALSTEQVVAIASHNGGKQALEAVKADLLDLRGAPYALSTEQVVAIASHNGGKQALEAVKAQLLDLRGAPYALSTAQVVAIASHNGGKQALEAVKAQLLDLRGAPYALSTAQVVAIASNGGGKQALEGIGEQLLKLRTAPYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSTEQVVAIASSHGGKQALEAVRALFPDLRAAPYALSTAQLVAIASNPGGKQALEAVRALFRELRAAPYALSTEQVVAIASNHGGKQALEAVRALFRELRAAPYALSTEQVVAIASNHGGKQALEAVRALFRGLRAAPYGLSTAQVVAIASSNGGKQALEAVWALLPVLRATPYDLNTAQVVAIASHYGGKPALEAVWAKLPVLRGVPYALSTAQVVAIACISGQQALEAIEAHMPTLRQAPHGLSPERVAAIACIGGRSAVEA

SEQ ID NO: 88 - protein, 174 aa, Ralstonia solanacearum
LSTAQLVAIASNPGGKQALEAVRAPFREVRAAPYALSPEQVVAIASNHGGKQALEAVRALFRGLRAAPYGLSTAQVVAIASSNGGKQALEAVWALLPVLRATPYDLSTAQVVAIASHDGGKPALEAVWAKLPVLRGAPYALSTAQVVAIACISGQQALEAIEAHMPTLRQAPHS

SEQ ID NO: 89 - protein, 559 aa, Ralstonia solanacearum
  MOD_RES (211)..(385): Any amino acid
LSTEQVVAIASNKGGKQALEAVKAHLLDLLGAPYVLDTEQVVAIASHNGGKQALEAVKADLLDLRGAPYALSTEQVVAIASHNGGKQALEAVKADLLDLRGAPYALSTEQVVAIASHNGGKQALEAVKAQLLDLRGAPYALSTEQVVAIASHNGGKQALEAVKAQLLDLRGAPYALSTEQVVAIASSHGGKQALEAVRALFPDLRAAPYAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSTAQLVAIASNPGGKQALEAIRALFRELRAAPYALSTEQVVAIASNHGGKQALEAVRALFRGLRAAPYGLSTAQVVAVASSNGGKQALEAVWALLPVLRATPYDLNTAQVVAIASHDGGKPALEAVWAKLPVLRGVPYELSTAQVVAIACISGQQALEVIEAHMPTLRQAPHS

SEQ ID NO: 90 - protein, 614 aa, Ralstonia solanacearum
  MOD_RES (246)..(420): Any amino acid
LTPQQVVAIASNTGGKRALEAVCVQLPVLRAAPYRLSTEQVVAIASNKGGKQALEAVKAHLLDLLGAPYVLDTEQVVAIASHNGGKQALEAVKADLLDLRGAPYALSTEQVVAIASHNGGKQALEAVKADLLDLRGAPYALSTEQVVAIASHNGGKQALEAVKAQLLDLRGAPYALSTEQVVAIASNNGGKQALEAVKAQLLDLRGAPYALSTAQVVAIASNGGGKQALEGIGEQLLKLRTAPYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSTAQLVAIASNPGGKQALEAIRALFRELRAAPYALSTEQVVAIASNHGGKQALEAVRALFRGLRAAPYGLSTAQVVAVASSNGGKQALEAVWALLPVLRATPYDLNTAQVVAIASHDGGKPALEAVWAKLPVLRGVPYELSTAQVVAIACISGQQALEVIEAHMPTLRQAPHSLSPERVAAIACIGGRSAVEA

SEQ ID NO: 91 - protein, 489 aa, Ralstonia solanacearum
  MOD_RES (141)..(350): Any amino acid
LSTEQVVAIASHNGGKQALEAVKADLLDLRGAPYALSTEQVVAIASHNGGKLALEAVKAHLLDLRGAPYALSTEQVVAIASHNGGKQALEAVKAQLLDLRGAPYALSTAQVVAIASNGGGKQALEGIGEQLLKLRTAPYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSTEQVVAIASNHGGKQALEAVRALFRGLRAAPYGLSTAQVVAVASSNGGKQALEAVWALLPVLRATPYDLNTAQVVAIASHDGGKPALEAVWAKLPVLRGVPYELSTAQVVAIACISGQQALEAIEAHMPTLRQAPHS

SEQ ID NO: 92 - protein, 139 aa, Ralstonia solanacearum
LSTEQVVAIASNHGGKQALEAVRALFRGLRAAPYGLSTAQVVAIASSNGGKQALEAVWALLPVLRATPYDLNTAQVVAIASHDGGKPALEAVWAKLPVLRGVPYALSTAQVVAIACISGQQALEAIEAHMPTLRQAPHS

SEQ ID NO: 93 - protein, 579 aa, Ralstonia solanacearum
  MOD_RES (246)..(350): Any amino acid
LTPQQVVAIASNTGGKRALEAVCVQLPVLRAAPYRLSTEQVVAIASNKGGKQALEAVKAHLLDLLGAPYVLDTEQVVAIASHNGGKQALEAVKADLLDLRGAPYALSTEQVVAIASHNGGKQALEAVKADLLELRGAPYALSTEQVVAIASHNGGKQALEAVKAHLLDLRGAPYALSTAQVVAIASHNGGKQALEAVKAQLLDLRGAPYALSTAQVVAIASNGGGKQALEGIGEQLRKLRTAPYGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSTEQVVAIASSHGGKQALEAVRALFPDLRAAPYALSTAQLVAIASNPGGKQALEAVRALFRELRAAPYALSTEQVVAIASNHGGKQALEAVRALFRGLRAAPYGLSTAQVVAIASSNGGKQALEAVWALLPVLRATPYDLNTAQVVAIASHDGGKPALEAVWAKLPVLRGVPYALSTAQVVAIACISGQQALEAIEAHMPTLRQAPHSLSPERVAAIACIGGRSAVEA

SEQ ID NO: 94 - protein, 489 aa, Ralstonia solanacearum
  MOD_RES (106)..(315): Any amino acid
LSTEQVVAIASNKGGKQALEAVKAHLLDLLGAPYVLNTEQVVAIASHNGGKQALEAVKADLLDLRGAPYALSTEQVVAIASHNGGKQALEAVKADLLELRGAPYAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSTAQVVAIASHDGGKQALEAVGAQLVELRAAPYALSTEQVVAIASHDGGKQALEAVGAQLVALRAAPYALSTEQVVAIASSHGGKQALEAVRALLPVLRATPYDLNTAQVVAIASHDGGKPALEAVRAKLPVLRGVPYALSTAQVVAIACISGQQALEAIEAHMPTLRQAPHS

SEQ ID NO: 95 - protein, 89 aa, Ralstonia solanacearum
LTPQQVVAIASHDGGKPALEAVWAKLPVLRGVPYALSTAQVVAIACISGQQALEAIEAHMPTLRQAPHSLSPERVAAIACIGGRSAVEA

SEQ ID NO: 96 - protein, 1164 aa, Xanthomonas citri
MDPIRSRTPSPARELLPGPQPDRVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASNGGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNSGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNSGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNCGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNSGGKQALETVQRLLPVLCQAHGLTPDQVVAIASHDGGKQALETVQRLLPVLCQAHGLTPEQVVAIASHDGGKQALETVQRLLPVLCQAHGLTPEQVVAIACNGGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 97 - protein, 1164 aa, Xanthomonas citri
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPQQVVAIASNGGGKQALETVQRLLPVLCQAHGLTPEQVVAIASNIGGKQALETVQRLLPVLCQAHGLTPEQVVAIASHDGGKQALETVQRLLPVLCQAHGLTPAQVVAIASNIGGKQALETVQRLLPVLCQAHGLTPEQVVAIASHDGGKQALETVQRLLPVLCQAHGLTPDQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNSGGKQALETVQRLLPVLCQAHGLTPDQVVAIASHDGGKQALETVQRLLPVLCQAHGLTPEQVVAIASNSGGKQALETVQRLLPVLCQAHGLTPEQVVAIACNGGGKQALETVQRLLPVLCQAHGLTPEQVVAIASNGGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMMQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 98 - protein, 1094 aa, Xanthomonas citri
MDPIRSRTPSPARELLPGPQPDRVQPTADRGVSPPAGGPLDGLPARRTMSRTRLPSPPAPLPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLHPGQVVAIASNIGGKQALETVQRLLPVLCQAHGLTPEQVVAIASNGGKQALETVQRLLPVLCQAHGLTPAQVVAIASNIGGKQALETVQRLLPVLCQAHGLTPAQVVAIASNGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPAQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 99 - protein, 1168 aa, Xanthomonas citri
MDPIRPRTSSPAHELLAGPQPDRVQPQPTADRGGAPPAGSPLDGLPARRTMSRTRLPSPPAPLPAFSAGSFSDLLCQFDPLLLDTLLFDSMSAFGAPHTEAAPGEADEVQSGLRAVDDPHPTVHVAVTAARPPRAKPAPRRRAAHTSDASPAGQVDLCTLGYSQQQQDEIKPKARATVAQHHQALMGHGFTRAHIVALSQHPAALGTVAVKYQAMIAALPEATHEDIVGVGKQWSGARALEALLTVSGELRGPPLQLDTGQLLKIAKRGGVTAVEAVHAWRNALTGAPLNLTPDQVVAIASHDGGKQALETVQRLLPVLCEQHGLTPDQVVAIASNGGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASNIGGKQALETVQRLLPVLCEQHGLTPDQVVAIASNGGGKQALETVQRLLPVLCEQHGLTPDQVVAIASNIGGKQALETVQRLLPVLCEQHGLTPAQVVAIASNGGGKQALETVQQLLPVLCEQHGLTPDQVVAIASNIGGKQALETVQRLLPVLCQAHGLTPDQVVAIASNIGGKQALETVQRLLPVLCEQHGLTPDQVVAIASHDGGKQALETVQRLLPVLCEQHGLTPDQVVAIASNGGGKQALETVQRLLPVLCEQHGLTPDQVVAIASHDGGKQALETVQRLLPVLCEQHGLTPDQVVAIASHDGGKQALETVQRLLPVLRQAHGLTPAQVVAIASHDGGKQALETVQRLLPVLCEQHGLTPDQVVAIASNGGGKQALETVQRLLPVLCEQHGLTPDQVVAIASNGGGKQALETVQRLLPVLRQAHGLTPAQVVAIASNGGGRPALESIFAQLSRPDQALAALTNDHLVALACLGGRPALEAVKKGLPHAPTLIKRTNRRLPERTSHRVADHAQVARVLGFFQCHSHPAQAFDEAMTQFGMSRHGLLQLFRRVGVTELEARGGTLPPAPQRWHRILQASGMKRAEPSGASAQTPDQASLHAFADALERELDAPSPIDQAGQALASSSRKRSRSESSVTGSFAQQAVEVRVPEQRDALHLPPLSWGVKRPRTRIGGGLPDPGTPMDADLAASSTVMWEQDADPFAGAADDFPAFNEEEMAWLMELFPQ

SEQ ID NO: 100 - protein, 1038 aa, Xanthomonas gardneri
MDPIRSRTPIPARELLPGPQPDRVQPTADRGVSPPVGGPLDGLPARRTMSQTRLPSPPAPMPAFSAGSFSDLLRQFDPSLLDTSLFDSVSAFGAPHTEAAPGELDEVQSVLRAADDPQPTVHVVVTAARPPRAKPAPRRRAAQPSDASPAAQVDLRTLGYSQQQQEKIKSKARSTVEQHHEALVGHGFTHAHIVELSKHPAALGTVAVKYQAMIAALPEATHEDVVGVGKQWSGARALEALLTVAGELRSPPLQLDTGQLFKIAKRGGVTAVEAVHAWRNALTGAPLNLTPEQVVAIASNNGGKQALETVQRLLPVLCQAPHDLTREQVVAIASIGGGKQALETVQRLLPVLCQAPHCLTREQVVAIASNIGGKQALETVQALLPVLCQAPHCLTREQVVAIASNIGGKQALETVQRLLPVLCQAPHCLTPEQVVAIASNIGGKQALETVQRLLPVLCQAPHCLTPEQVVAIASHDGGKQALETVQRLLPVLCQAPHDLTPEQVVAIACHDGGKQALETVQRLLPVLRHAHGLTREQVVAIASNGGGKQALETVQALLPVLRQAHGLTREQVVAIASNNGGKQALETVQRLLPVLRQAHGLTREQVVAIASNIGGKQALETVQRLLPVLCQAPHDLTREQVVAIASHDGGKQALETVQRLLPVLCQAPHDLTREQVVAIASHDGGKQALETVQRLLPVLCQPPHDLTPEQVVAIACHDGGKQALETVQALLPVLRQAHGLTREQVVAIASNGGGKQALESIFAQLSRPDPALAALTNDRLVALACIGGRSALNAVKDGLPNALTLITRANSRIPERTSHLVADHTQVVRVLGFFQCHSHPAQAFDEAMTQFGMSRHGLLQLFRRVGVTELEARSGTLPPASQRWHRMLQASGIKRAKPSSASAQTPDQESLHAFADSLERELDAPSPMDQAGQVLASSRRKRSRSDRSVTGSSAQQAVEVLVPEQRDALHLPLLSWGVKRPRTRIGGLLDPGTPMDADLVASSTVVWEQDADPFAGTADDFPAFNEEELALLMELLPH

SEQ ID NO: 101 - protein, 1272 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAAYDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTKAGELRGPPLQLDTGQLLKIAKRGGVTAVEAVHAWRNALTGAPLNLTPDQVVAIANNNGGKQALETVQRLLPVLCQAHGLTPDQVVAIASHDGGKQALETVQRLLPVLCQAHGLTPDQVVAIASHDGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIANNNGGKQALETVQRLVPVLCQDHGLTQDQVVAIASNIGGKQALETVQRLLPVLYQDHGLTQDQVVAIASHDGGKQALETVQRLLPVLCQDHGLTPDQVVAIASHDGGKQALETVQRLLPVLCQEHGLTPDQVVAIASHDGGKQALETVQRLLPVLCQDHGLTPDQVVAIASHGGGKQALGTVQRLLPVLCQDHGLTPDQVVAIANNNGGKQALETVQRLLPVLCQDHGLTPDQVVAIANNNGGKQALETVQRLLPVLCQAHGLTPDQVVAIASHDGGKQALETVQRLLPVLCQDHGLTPAQVVAIASNSGGKQALETVQRLLPVLCQDHGLTPAQVVAIANNNGGKQALETVQRLLPVLCQDHGLTPDQVVAIASHDGGKQALETVQRLLPVLCQDHGLTLDQVVAIASNGGKQALETVQRLLPVLCQAHGLTPNQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTDPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 102 - protein, 1007 aa, Xanthomonas oryzae
MPAVGTPHTAAAPAEWDEAQSALRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLTDAGELRGPPLQLDTGQLVKIAKRGGVTAMEAVHASRNALTGAPLNLTPAQVVAIASHDGGKQALETVQRLLPVLCQDHGLTRDQVVAIASHDGGKQALETVQRLLPVLCQDHGLPPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETLQRLLPVLCQAHGLTPAQVVAIASHDGGKQALETVQRLLPVLCQAHGLTPDQVVAIANNNGGKQAVGTVQRLLPVLCQAHGLTPAQVVAIASHDGGKQALETVQRLLPVLCQAHGLTPDQVVAIASNGGGKQALETVQRLLPVLCQAHGLTLAQVVAIASHGGGKQALETVQRLLPVLCQAHGLTPDQVVAIANNNGGKQALETVQRLLPVLCQAHGLTPDQVVAIASHDGGKQALETVQRLLPVLCQAHGLTPAQVVAIASNGGKQALETVRRLLPVLCQAHGLTPDQVVAIASNGGGKQALETVQRLLPVLCQDHGLTPDQVVAIASNGGGKQALESIVAQLSRRDPALAALTNDHLVALACLGGRPALDAVKKGLPHAPEFIRRVNRRIAERTSHRVADYAHVVRVLEFFQCHSHPAHAFDEAMTQFGMSRHGLVQLFRRVGVTEFEARYGTLPPASQRWDRILQASGMKRAKPSPTSAQTPDQTSLHAFADSLERDLDAPSPMHEGDQTRASSRKRSRSDRAVTGPSAQQAVEVRVPEQRDALHLPLSWRVKRPRTRIWGGLPDPGTPMAADLAASSTVMWEQDADPFAGAADDFPAFNEEELAWLMELLPQ

SEQ ID NO: 103 - protein, 906 aa, Xanthomonas oryzae
MPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTDAGELRGPPLQLDTGQLVKIAKRGGVTAVEAVHASRNALTGAPLNLTPDQVVAIASNIGGKQALETLQRLLPVLCQAHGLTPDQVVAIANNNGGKQALETVQRLLPVLCQAHGLTPDQVVAIASNIGGKQALETVQRLLPVLCQAHGLTPDQVVAIASNIGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIANNNGGKQALETVQRLLPVLCQHHGLIPDQVVAIASNIGGKQALETVQRLLPVLCQHHGLTPDQVVAIASNNGGKQALETVQRLLPVLCQHHGLTPAQVVAIASNIGGKQALETVQRLLPVLCQDHGLTPDQVMAIANNNGGKQALETVQRLLPVLCQAHGLTPDQVVAIASHDGGKQALEGIVAQLSRPDPALTALTNDHLVALACLGGRPALDAVKKGLPHAPELIRRVNSRIGERTSHRVADYAQVVRVLEFFQCHSHPAHAFDEAMTQFGMSRHGLVQLFRRVGVTELEARCGTLPPASQRWDRILQASGMKRAKPSPTSAQTPDQASLHAFADSLERDLDAPSPMHEGDQTRASSRKRSRSDRAVTGPSAQQAVEVRVPEQRDALHLPLSWRVKRPRTRIGGGLPDPGTPMAADLAASSTVMWEQDADHFAGAADDFPAFNEEELAWLMELLPQ

SEQ ID NO: 104 - protein, 906 aa, Xanthomonas oryzae
MPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVKYQHIITALPEATHEDIVGVGKQWSGARALEALLTKAGELRGPPLQLDTGQLLKIARRGGVTAVEAVHAWRNALTGAPLNLTPAQVVAIASNNGGKQALETVQRLLPVLCQAHGLTPDQVVAIASHDGGKQALETVQRLLPVLCQAHGLTPDQVVAIASNIGGKQALETVQRLLPVLCQAHGLTPDQVVAIANNKGGKQALETVQRLLPVLCQAHGLTPDQVVAIASHDGGKQALETVQRLLPVLCQAHGLTPAQVVAIASHDGGKQALETVQRLLPVLCQAHGLTPAQVVAIASHDGGKQALETVQRLLPVLCQAHGLTPAQVVAIASNGGGKQALETVQRLLPVLCQDHGLTLDQVVAIASNIGGKQALETVQRLLPVLCQDHGLTLDQVVAIASNNGGKQALETVQRLLPVLCQAHGLIPAQVVAIASHDGGKQALETVQRLLPVLCQDHGLIPAQVVAIASHDGGKQALETVQRLLPVLCQDHGLTPAQVVAIASNGGGKQALESIVAQLSRPDPALAALTNDHLVALACLGGRPALDAVKKGLPHAPELIRRVNRRIAERTSHRVADLAHVVRVLEFFQCHSHPAHAFDEAMTQFGMSRHGLVQLFRRVGVTELEASGGTLPPASQRWHRILQASGMKRAKPSPTSAQTPDQASLHAFADSLERDPDAPSPMHEGDQTRASSRKRSRSDRAVTGPSAQQAVEVRVPEQRDALHLPLSWSVKRPRTRIGGGLPDPGTPMAADLAASSTVMWEQDADPFAGAADDFPAFNEEELAWLMELLPQ

SEQ ID NO: 105 - protein, 813 aa, Xanthomonas oryzae
MYQHIITALPEATHEDIVGVGKQLSDARALEALLTKAGELRGPPLQLDTGQLLKIARRGGVTAVEAVHAWRNALTGAPLNLTPDQVVAIASNSGGKQALETVQRLLPVLCQDHGLTPDQVVAIASNDGGKQALETVQRLLPVLCQDHGLTPDQVVAIASHGGGKQALEAVQRLLPVLCQDHGLTPDQVVAIASHGGGKQALETVQRLLPVLCQDHGLTPDQVVAIASHGGGKQALEAVQRLLPVLCQAHGLTPDQVVAIASNGGGKQALETVLRQAHGLTPDQVVAIASHGGGKQALETVQRVLPVLCQAHGLTLDQVAAIASHGGGKQALETVQRLLPVLCQAHGLTPDQVVAIASHDGGKQALETVQRLLPVLCQAHGLTPNQVVAIASHDGGKQALETVQRLLPVLCQAHGLTLDQVVAIASHDGGKQALETVQRLLPVLCQTHGLTPAQVVAIASNNGGKQALETVQRLLPMLCQAHGLTPAQVVAIASNNGGKQALETVQRLLPMLCQDHGLTPDQVVAIASHDSGKQALETMQRLLPVLCQDHGLTPDQVVAIASHGGGKQALETVQRLLPVLCQDHGLTPDQVVAIASHHGGKQALETVQRLLPVLCQDHGLTPDQVVAIASHGGKQALETVQRLLPVLCQDHGLTPDQVVAIASHGGKQALETVQRLLPVLCQDHGLTPDQVVAIASNNGGKQALETVRRLLQVLCQDHGLTPDQVVAIASHDGGKQALETVQRLLPVLCQAHGLTPDQVVAIASHGGKQALESIVAQLSRRDPALAALTKDQLVALACFGGRPAPHSRKRKSHD

SEQ ID NO: 106 - protein, 1041 aa, Xanthomonas oryzae
MPAVGTPHTAAAPAEWDEAQSGLRAADDPPPTVRVAVTAARPPRAKPAPRRRAAQPSDASPAAQVDLSTLGYSQQQQEKIKPNVRSTVAQHHEALVGHGFTHAHIVALSQHPAALGTVAVTYQHIITALPEATHEDIVGVGKQWSGARALEALLADAGELRGPPLQLDTGQLLKIAKRGGVTAVEAVHASRNALTGAPLNLTPAQVVAIASNNGGKQALETVQRLLPVLCQAHGLTPDQVVAIASNNGSKQALETVQRLLPVLCQDHGLTPDQVVAIASNDGGKQALETVQRLLPVLCQDHGLSPDQVVTIASNGGKQALETLQRLLPVLCQDHGLTPDQVVAIASNSGGKQALETVQRLLPVLCQDHGLTPDQVVAIASNSGGKQALETVQRLLPVLCQAHGLTPDQVVAIASYGGGKQALETVQRVLPVLCQDHGLTPDQVVAIASNIGGKQALETLQRLLPVLCQDHGLTPDQVVAIANSNGGKQALETVQRLLPVLCQDHGLTPDQVVAIASHDGGKQALETVQRLLPVLCQDHGLTPDQVVAIASHDGSKQALETVQRLLPVLCQDHGLTPDQVVAIASNGGGKQALETVQRLLPVLCQDHGLTPDQVVAIASHDGGKQALETVQRLLPVLCQDHGLTPAQVVAIASNSGGKQALETVQRLLTVLCQDHGLTTDQVVAIANNNGGKQALETVQRLLPVLCQDHGLTTDQVVAIASHDGGKQALETVQRLLPVLCQDHGLTPAQVVAIASNGGGKQALESIVAQLSRPDPALAALTNDHLVALACLGGRPALDAVKKGLPHAPEFIRRVNRRIAERTSHRVADYAQVVRVLEFFQCHSHPAHAFDEAMTQFGMSRQGLVQLFRRVGVTELEARCGTLPPASQRWDRILQASGMKRGKPSPTSAQTPDQASLHGFADSLERDLDAPSPMHEGDQTRASSRKRSRSDHAVTGPSAQQAVEVRVPEQRDALHLPLSWSVKRPRTRIGGGLPDPGTPMAADLAASSTVMWEQDAAPFAGAADDFPAFNEEELAWLMELLPQ

SEQ ID NO: 107 - protein, 1035 aa, Xanthomonas oryzae
MQSALRAADDPPPTVRVAVTAARPPRAKPAPRRRAAQPSDASPAAQVDLRTLGYSQQQQEKIKPNVRSTVAQHHEALVGHGFTHAHIVALSQHPAALGTVAVTYQHIITALPEATHEDIVGVGKQWSGARALEALLTKAGELRGPPLQLDTGQLLKIAKRGGVTAVEAVHASRNALTGAPLNLTTDQVVAIASHDGGKQALETVQRLLPVLCQAHGLTPDQVVAIASHDGGKQALETVQRLLPVLCQDHGLTPDQVVAIASNGGGKQALETVQRLLPVLCQDHGLTPDQVVAIASNIGGKQALETVQRLLPVLRQDHGLTPDQVVAIASHGGGKQALETVQRLLPVLCQDHGLTPAQVVAIASHDGGKQALETVQRLLPVLCQDHGLTPDQVVATASHGGGKQALETVQRLLPVLCQDHGLTPDQVVAVASNIGGKQALETVQRLLPVLCQAHGLTPDQVVAIASHDGGKQALETVQRLLPVLCQAHGLTPDQVVAIANNNGGKQALETVQRLLPVLCQDHGLTPAQVVAIASHDGGKQALETVQRLLPVLCQDHGLTPDQVVAIASHGGGKRALETVQRLLPVLCQAHGLTPAKVVAIASHGGGKQALETVQRLLPVLCQDHGLTPDQVVAIASHGGGKQALETVQRLLPVLCQDHGLTLDQVVAIASNGGSKQALETVQRLLPVLCQDHGLTPDQVVAIASNIGGKQALETVQRLLPVLCQDHGLTPAQVVAIASNGGGKQALESIVAQLSRPDPALAALTNDHLVALACLGGRPALDAVKKGLPHAPELIRKINRRIPERTSHRVADLPERTSNRVADLAHVVRVLGFFQSHSHPAQAFDDAMTQFGMSRHGLVQFFRRVGVTELEARCGTLPPASQRWDRILQASGMKRAEPSPTSAQTPDQASLHAFADSLERDLDAPSPMHEGDQTRASSRKRSRSDRAVTAPSAQQAVEVRVPEQRDALHLPLSWSVKRPRTRIGGGLPDPGTPMAADLAASSTVMWEQDADHFAGAADDFPAFNEEELAWLMELLPQ

SEQ ID NO: 108 - protein, 1007 aa, Xanthomonas oryzae
MPAVGTPHTAAAPAEWDEAQSGLRAADDPPPTVRVAVTAARPPRAKPAPRRRAAQSSDASPAAQVDLRTLGYSQQQQEKIEPNVRSTVAQHHEALVGHGFTHAHIVALSQHPAALGTVAVTYQHIITALPEATHEDIVGVGKQWSGARALEALLTKAGELRGPPLQLDTGQLVKIAKRGGVTAVEAVHAWRNALTGAPLNLTPDQVVAIASNIGGKQALETLQRLLPVLCQDHGLTPDQVVAIANNNGGKQALETVQRLLPVLCQAHGLTPDQVVAIASNIGGKQALETVQRLLPVLCQDHGLTPDQVVAIASNIGGKQALETVQRLLPVLCRDHGLTPDQVVAIASNIGGKQALETVQRLLPVLCQAHGLTPDQVVAIASNIGGKQALETVQRLLPVLCQDHGLTPDQVVAIASNGGKQALETVQRLLPVLCQDHGLTPDQVVAIASNIGGKQALETVQRLLPVLCQDHGLTPDQVVAIASNGGGKQALETVQRLLPVLCQDHGLTPDKVVAIANNNGGKQALETVQRLLPVLCQDHGLTPAQVVTIASNNGGKQALETVQRLLPVLCQDHGLTPAQVVTIASNNGGKQALETVQRLLPVLCQDHGLTPDQVVAIASNIGSKQALETVQRLLPVLRQDHGLTPAQVVAIASNSGGKQALETVQRLLPVLCQDHGLTPDQVVAIASNGGGKQALETVQRLLPVLCQDHGLTPDQVVAIASNGGGKQALESIVAQLSRPDPALAALTNDHLVALACLGGRPALDAVKKGLPHAPELIRRVNRRIGERTSHRVADYAQVVRVLEFFQCHSHPAHAFDEAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTDPSAQQAVEVRVPEQRDALHLPLSWSVKRLRTRIGGGLPDPGTPMAADLAASSTVMWEQDADPFAGAADDFPAFNEEELAWLMELLPQ

SEQ ID NO: 109 - protein, 1006 aa, Xanthomonas oryzae
MPAVGTPHTAAAPAEWDEVQSALRAADDPPPTVRVAVTAARPPRAKTAPRRRAAQSSDASPAAQVDLRTLGYSQQQQEKIKPNVRSTVAQHHEALVGHGFTHAHIVALSQHPAALGTVAVTYQHIITALPEATHEDIVGVGKQWSGARALEALLTKAGELRGPPLQLDTGQLLKIAKRGGVTAVEAVHASRNALTGAPLNLTPAQVVAIASNIGGKQALETLQRLLPVLCQDHGLTPDQVVAIASHGGGKQALETVQRLLPVLCQDHGLTPDQVVAIASNGGKQALETVQRLLPVLCQDHGLTPDQVVAIANNNGGKQALETLQRLLPVLCQAHGLTPDQVVTIASNGGKQALETVQRLLPVLCQDHGLTPDQVVAIASHDGGKQALETVQRLLPVLCQAHGLTPDQVVAIASHGGGKQALETVQRLLPVLCQDHGLTPDQVVAIASHDGGKQALETMQRLLPVLCQDHGLTPAQVVAIASNNGGKQALETVQRLLPVLCQDHGLTPDQVVAIASHDGGKQALETVQRLLPVLCQDHGLTPDQVVSIANNKGGKQALETVQRLLPVLCQAHGLTPGQVVAIASHGGGKRALETVQRLLPVLCQDHGLTLAQVVAIANNNGGKQALETVQRLLPVLCQDHGLTLAQVVAIANNNGGKQALETVQRLLPVLCQAHGLTPDQVVAIASNGGGKQALETVQRLLPVLCQDHGLTPAQVVAIASHDGGKQALEGIVAQLSRPDPALTALTNDHLVALACLGGRPALDAVKKGLPHAPELIRRVNSRIPERTSHHVADLAQVVRVLEFFQCHSHPAHAFDEAMTQFGMSRHGLVQLFRRVGVTEFEARYGTLPPASQRWDRILQASGMKRAEPSPTSAQTPDQASLHAFADSLERDLDAPSPMHEGDQTRASSRKRSRSDRAVTDPSAQQSFEVRVPEQRDALHLPLSWSVKRPRTRIWGGLPDPGTPMAADLAASSTVMWEQDADPFAGAADDFPAFNEEELAWLMELLPQ

SEQ ID NO: 110 - protein, 1379 aa, Xanthomonas oryzae
MPAVGTPHTAAAPAEWDEAQSVLRAADDPPPTVRVAVTAARQPRAKPAPRRRAAQPSDASPAAQVDLRTLGYSQQQQEKIKPNVRSTVAQHHEALVGHGFTHAHIVALSQHPAALGTVAVTYQHIITALPEATHEDIVGVGKQWSGARALEALLTKAGELRGPPLQLDTGQLLKIARRGGVTAVEAVHASRNALTGAPLNLTTDQVVAIASHDGGKQALETVQRLLPVLCQAHGLTPAQVVTIASHDGGKQALETVQRLLPVLCQDHGLTPAQVVAIASNNGGKQALETVQRLLPVLCQDHGLTPAQVVAIASNNGGKQALETVQRLLPVLCQDHGLTPDQVMAIASNGGGKQALETVQRLLPVLCQDHGLTPDQVVAIASNGGKQALETVQRLLPVLCQDHGLPPAQVVAIASHDGGKQALETVQRLLPVLCQDHGLTPAQVVAIASNIGGKQALETVQRLLPVLCQDHGLTLDQVVAIASNGGSKQALETVQRLLPVLCQAHGLTPDQVVAIASHDGGKQALETVQRLLPVLCQDHGLTPDQVVTIASNGGGKQALETVQRLLPVLCQDHGLTPDQVVTIASNSGGKQALETVQRLLPVLCQDHGLTPDQVMAIASHDGGKQALETVQRLLPVLCQDHGLTPDQVVAIASHAGGKQALETVQRLLPVLCQDHGLTPDQVVAIASNDGGKQALETVQRLLPVLCQDHGLTPDQVVAIASNGGKQALETVQRLLPVLCQDHGLTPDQVVAIASNDGGKQALETVQRLLPVLCQDHGLTPDQVVAIANNNGGKQALETVQRLLPVLCQDHGLTPDQVVAIASHDGGKQALETVQRLLPVLCQTHGLTPAQVVAIASNNGGKQALETVQRLLPVLCQDHGLTPDQVVAIASNNGGKQALETVQRLLPVLCQDHGLTLDQVVAIASHDGGKQALETVQRLLPVLCQDHGLTPDQVVAIASHDGGKQALETVQRLLPVLCQDHGLTPDQVVAIASNGGKQALETVQRLLTVLCQDHGLTPAQVVAIANNNGGKQALETVQRLLPVLCQDHGLTPAQVVAIASNGGGKQALETVQRLLPVLCQDHGLTPAQVVAIASHDGGKQALEGIVAQLSRPDPALTALTNDHLVALACLGGRPALDAVKKGLPHAPELIRRVNRRIPERTSHHVADLAQVVRVLEFFQCHSHPAHAFDEAMTQFGMSRHGLVQLFRRVGVTEFEARYGTLPPASQRWDRILQASGMKRAEPSPTSAQTPDQASLHAFADSLERDLDAPSPMHEGDQTRASSRKRSRSDRAVTAPSAQQSFEVRVPEQRDALHLPLSWSVKRPRTRIGGGLPDPGTPMAADLAASSTVMWEQDADHFAGAADDFPAFNEEELAWLMELLPQ

SEQ ID NO: 111 - protein, 651 aa, Xanthomonas oryzae
MQRLLPVLCQDHGLTPDQVVAIASHDGGKQALETVQRLLPVLCQDHGLTPDQVVAIANNNGGKQALETVQRLLPVLCQDHGLTPAQVVAIASNNGGKQALETVQRLLPVLCQDHGLTLDQVVAIASNGGSKQALETAQRLLPVLCQAHGLTPDQVVAIASHDGGKQALETAQRLLPVLCQAHGLTPAQVVAIANNNGGKQALETVQRLLPVLCQDHGLTPAQVVAIASNNGGKQALETVQRLLPVLCQDHGLTLDQVVAIASNGGGKQALETVQRLLPVLCQDHGLTTDQVVAIANNNGGKQALETVQRLLPVLCQDHGLTPNQVVAIASNIGGKQALETVQRLLPVLCQDHGLTPAQVVAIASNGGGKQALESIVAQLSRPDPALAALTNDHLVALACLGGRPALDAVKKGLPHAPELIRRVNRRIPERTSHRVADLAQVVRVLEFFQCHSHPAHAFDEAMTQFGMSRHGLVQLFRRVGVTEFEARYGTLPPASQRWDRILQASGMKRAEPSPTSAQTPDQASLHAFADSLERDLDAPSPMHEGDQTRASSRKRSRSDRAVTDPSAQQSFEVRVPEQRDALHLPLSWSVKRPRTRIGGGLPDPGTPMAADLAASSTVMWEQDADHFAGAADDFPAFNEEELAWLMELLPQ

SEQ ID NO: 112 - protein, 845 aa, Xanthomonas oryzae
MPAVGTPHTAAAPAEWDEAQSGLRAADDPPPTVRVAVTAARPPRAKPAPRRRAAQPSDASPAAQVDLRTLGYSQQQQEKIKPNVRLTVAQHHEALVGHGFTHAHIVALSQHPAALGTVAVTYQHIITALPEATHEDIVGVGKQWSGARALEALLTKAGELRGPPLQLDTGQLLKIAKRGGVTAVEAVHASRNALTGAPLNLTPAQVVAIASNIGGKQALETVQRLLPVLCQDHGLTPDQVVAIASHGGGKQALETVQRLLPVLCQDHGLTPDQVVAIASNIGGKQALETVQRLLPVLCQDHGLTPAQVVAIASNGGKQALETLQRLLPVLCQDHGLTPDQVVAIASHNGGKQALETVQQLLPVLCQDHGLTPDQVVAIASNGGGKQALETVQRLLPVLCQDHGLTPDQVVAIASNNGGKQALETVQRLLPVLCQDHGLTPDQVVATASNDGGKQALETVQRLLPVLCQDHGLTPDQVVAIASHDGGKQALETVQRLLPVLCQDHGLTPDQVVAIASNGGGKQALETVQRLLPVLCQDHGMTPDQVVAIASHDGGKQALETVQRLLPVLCQDHGLTPDQVVAIASNIGGKQALETVQRLLPVLCQDHGLTPAQVVAIASHGGGKQALETVQRLLPVLCQDHGLPPDQVVAIASHGGSKQALETVQRLLPVLCQDHGLTPDQVVAIASHDGGKQALETVQRLLPVLCQDHGLTPDQVVAIASNNGGKQALETVQRLLPVLCQDHGLTPAQVVAIASHDGSKQALETVQRLLPVLCQDHGLTPDQVVAIASHHGGKQALETVQRLLPVLCQDHGLTPDQVVAIASNGAASRRWRRCSGCCRCCARTMA

SEQ ID NO: 113 - protein, 1158 aa, Xanthomonas oryzae
MQSALRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLTDAGELRGPPLQLDTGQLVKIAKRGGVTAVEAVHASRNALTGAPLNLTPAQVVAIASHDGGKQALETVQRLLPVLCQAHGLTPNQVVAIASHDGGKQALETVQRLLPVLCQDHGLTPDQVVAIASNCGGKQALETVQRLLPVLCQAHGLTPDQVVAIASHDGGKQALETVQRLLPVLCQDHGLTPDQVVAIASNCGGKQALETVQRLLPVLCQDHGLTPDQVVAIASNGGGKQALETVQRLLPVLCQDHGLTPAQVVAIASHDGGKQALETVQRLLPVLCQAHGLTPDQVVTIASHHGGKQALETVQRLLPVLCQDHGLTPDQVVAIASHDGGKQALETVQRLLPVLCQDHGLTLAQVVAIASNIGGKQALETVQRLLPVLCQAHGLTPDQVVAIASNGGGKQALETVQRLLPVLCQAHGLSPDQVVAIASNGGKQALETVQRLLPVLCQDHGLTPAQVLAIASNSGGKQALETVQRLLTVLCQDHGLTTDQVVAIASNGGKQALETVQRLLPVLCQAHGLTTDQVVAIASHDGGKQALETVQRLLPVLCQAHGLTPAQVVAIASHDGGKQALETVQRLLPVLCQDHGLTPDQVVAIASNSGGKQALETVQRLLTVLCQDHDLTPDQVVAIASNIGGKQALETVQRLLTVLCQDHGLTPDQVVAIASHGGGKQALETVQRLLPVLCQDHGLTPDQVVAIASHDGGKQALETVQRLLPVLCQDHGLTPDQVVAIASNGGGKQALESIVAQLSRRDPALAALTNDHLVALACLGGRPALDAVKKGLPHAPEFIRRVNSRIAERTSHRVADYAHVVRVLEFFQCHSHPAQAFDDAMTQFGMSRHGLVQLFRRVGVTEFEARYGTLPPASQRWDRILQASGMKRAKPSPTSAQTPDQTSLHAFADSLERDLDAPSPMHEGDQTRASSRKRSRSDRAVTGPSAQQAVEVRVPEQRDALHLPLSWSVKRPRTRIGGGLPDPGTPIAADLAASSTVMWEQDVDHFAGAADDFPAFNEEELAWLRELLPQ

SEQ ID NO: 114 - protein, 1058 aa, Xanthomonas oryzae
MQSALRAADDPSPTVRVAVTAARQPRAKPAPRRRAAQPSDASPAAQVDLRTLGYSQQQQEKIKPNVRSTVAQHHEALVGHGFTHAHIVALSQHPAALGTVAVTYQHIITALPEATHEDIVGVGKQWSGARALEALLTKAGELRGPPLQLDTGQLLKIAKRGGVTAVEAVHASRNALTGAPLNLTPAQVVAIASNNGGKQALETVQRLLPVLCQAHGLPPAQVVAIASHDGGKQALETVQRLLPVLCQAHGLTPAQVVAIASNIGGKQALETVQRLLPVLCQDHGLTPDQVVAIASNIGGKQALETMQRLLPVLCQAHGLTPDQVVAIASNGGGKQALETVQRLLPVLCQDHGLTPDQVVAIASNNGGKQALETVQRLLPVLCQAHGLTPDQVVAIASNNGGKQALETVQRLLPVLCQAHGLSPDQVVAIASHDGGKQALETVQRLLPVLCQAHGLTPDQVVAIASNNGGKQALETVQRLLPVLCQAHGLTLAQVVAIASNIGGKQALETVQRLLPVLCQTHGLTPAQVVAIASNIGGKQALETVQRLLPVLCQAHGLTPAQVVAIANNNGGKQALETVQRLLPVLCQAHGLTPAQVVAIANNNGGKQALETVQRLLPVLCQAHGLTLDQVVAIANNNGGKQALETVQRLLPVLCQAHGLTPDQVVAIASNGGGKQALETVQRLLPVLCQDHGLSPAQVVAIASNIGSKQALETVQRLLPVLCQDHGLTPAQVVAIASHDGGKQALETVQRLLPVLCQDHGLTPDQVVAIASNGGGKQALESIVAQLSRPDPALAALTNDHLVALACLGGRPALDAVKKGLPHAPELIRRVNSRIGERTSHRVADYAQVVRVLEFFQSHSQPAQAFDDAMAQFGMSRHGLVQLFRRVGVTELEASGGTLPPASQRWDRILQASGMKRAKPSPTSAQTPDQASLHAFADSLERDPDAPSPMHEGDQTRASSRKRSRSDRAVTGPSAQQSFEVRVPEQRDALHLPLSWSVKRPRTRIGGGLPDPGTPMAADLAASSTVMWEQDADPFAGAADDFPAFNEEELAWLMELLPQ

SEQ ID NO: 115 - protein, 1074 aa, Xanthomonas oryzae
MPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLTKAGELRGPPLQLDTGQLVKIAKRGGVTAVEAVHASRNALTGAPLNLTPDQVVAIASNIGGKQALETLQRLLPVLCQAHGLTPAQVVAIASNGGKQALETVQRLLPVLCQAHGLTPAQVVAIASNIGGKQALETVQRLLPVLCQDHGLTPAQVVAIASNIGGKQALETVQRLLPVLCQAHGLTPAQVVAIASNNGGKQALETVQRLLPVLCQDHGLSPDQVVAIASNGGKQALETVQRLLPVLCQAHGLTPDQVVAIASNIGGKQALETVQRLLPVLCQAHGLTPDQVVAIANNKGGKQALETVQRLLLVLCQAHGLTPDQVVAIASHDGGKQALETVQRLLPVLCQAHGLTPAQVVAIASHDGGKQALETVQRLLPVLCQAHGLTPAQVVAIASHDGGKQALETVQRLLPVLCQAHGLTPAQVVAIASNGGGKQALETVQRLLPVLCQDHGLTLAQVVAIASNIGGKQALETVQRLLPVLCQAHGLTPDQVVTIANNNGSKQALETVQRLLPVLCQAHGLTPAQVVAIASHDGGKQALETVQRLLPVLCQAHGLTPDQVVAIANNNGGKQALETVQRLLPVLCQAHGLTPDQVVAIASHDGGKQALETVKRLLPVLCQDHGLTPAQVVAIASNGGGKQALESIVAQLSRPDPALAALTNDHLVALACLGGRPALDAVKKGLPHAPELIRRVNSRIGERTSHRVADYAQVVRVLEFFQCHSHPAHAFDEAMTQFGMSRQGLVQLFRRVGVTELEARCGTLPPASQRWDRILQASGMKRAKPSPTSAQTPDQASLHAFADSLERDLDAPSPMHEGDQTRASSRKRSRSDRAVTGPSAQQAVEVRVPEQRDALHLPLSWRVKRPRTRIGGGLPDPGTPMAADLAASSTVMWEQDAAPFAGAADDFPAFNEEELAWLMELLPQ

SEQ ID NO: 116 - protein, 989 aa, Xanthomonas oryzae
MQSALRAADEPPPTVRVAVTAARPPRAKPAPRRRAAQPSDASPAAQVDLRTLGYSQQQQEKIKPNVRSTVAQHHEALVGHGFTHAHIVALSQHPAALGTVAVKYQHIITALPEATHEDIVGVGKQWSGARALEALLTKAGELRGPPLQLDTGQLLKIARRGGVTAVEAVHAWRNALTGAPLNLTPAQVVAIASNNGGKQALETVQRLLPVLCQAHGLTPDQVVAIASHDGGKQALETVQRLLPVLCQAHGLTPAQVVAIASNIGGKQALETVQRLLPVLCQAHGLTPAQVVAIASHDGGKQALETVQRLLPVLCQDHGLTPDQVVAIASNNGGKQALETVQRLLPVLCQDHGLTPAQVVAIASNGGGKQALETVQRLLPVLCQDHGLTPAQVVAIASNGGGKQALETVQRLLPVLCQAHGLTPDQVVAIASHDGGKQALETVQRLLPVLCQAHGLTPDQVVAIASNNGGKQALETVQRLLPVLCQAHGLTPAQVVAIASHDGGKQALETVQRLLPVLCQAHGLTPDQVVAIASNGGKQALETVQRLLPVLCQDHGLTLDQVVAIASNNGGKQALETVQRLLPVLCQARGLTPDQVVAIASHDGGKQALETVQRLLPVLCQDHGLIPAQVVAIASHDGGKQALETVQRLLPVLCQDHGLTPDQVVAIASHDGGKQALETVQRLLPVLCQDHGLTPDQVVAIASNGGGKQALESIVAQLSRPDPALAALTNDHLVALACLGGRPALDAVKKGLPHAPELIRRVNSRIGERTSHRVADYAQVVRVLEFFQSHSQPAQAFDDAMTQFGMSRHGLVQLFRRVGVTELEASGGTLPPASQRWHRILQASGMKRAKPSPTSAQTPDQASLHAFADSLERDPDAPSPMHEGDQTRASSRKRSRSDRAVTGPSAQQSFEVRVPEQRDALHLPLSWSVKRPRTRIGGGLPDPGTPMAADLAASSTVMWEQDADPFAGAADDFPAFNEEELAWLMELLPQ

SEQ ID NO: 117 - protein, 1244 aa, Xanthomonas oryzae
MPAVGTPHTAAAPAEWDEAQSGLRAADDPPPTVRVAVTAARPPRAKPAPRRRAAQPSDASPAAQVDLRTLGYSQQQQEKIKPNVRSTVAQHHEALVGHGFTHAHIVALSQHPAALGTVAVTYQHIITALPEATHEDIVGVGKQWSGARALEALLTDAGELRGPPLQLDTGQLVKIAKRGGVTAVEAVHAWRNALTGAPLNLTPDQVVAIASNSGGKQALEMVQRLLPVLCQDHGLTPDQVVAIASHGGGKQALETVQRLLPVLCQDHGLTPDQVVAIASNIGGKQALETVQQLLPVLCQAHGLTPDQVVATASNGGGKQALETVQRLLPVLCQDHGLAPDQVVAVASNSGGKQALETVQRLLPVLCQDHGLTPDQVVAIANNNGGKQALETVQRLLPVLCQDHGLTPDQVVAIASNDGGKQALETVQRLLPVLCQDHGLSPDQVVAIASNGGKQALETVQRLLPVLCQDHGLTLDQVVAIASNGGGKQALETVQRLLPVLCQDHGLTPDQVVAIASNGGKQALETVQRLLPVLCQDHGLTPAQVVAIASHNGGKQALKTVQRLLPVLCQAHGLTPDQVVAIANNNGGKQALETVQRLLPVLCQDHGLTPDQVVAIASHDGGKQALETVQRLLPVLCQAHGLTPDQVVAIASNSGGKQALETVQRLLPVLCQDHGLTPDQVVAIASNIGGKQALETVQRLLPVLCQAHGLTPDQVVAIANNNGGKQALETVQRLLPVLCQAHGLTPAQVVAIASHDGGKQALETVQRLLPVLCQDHGLTPAQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASHGGGKQALETVQRLLPVLCQDHGLTPDQVVAIASHDGGKQALETVQRLLPVLCQDHGLTPDQVVAIASNGGGKQALESIVAQLSRPDPALAALTNDHLVALACIGGRPALDAVKKGLPHAPNLIRRVNRRIPERTSHRVADYAQVVRVLEFFQCHSHPAHAFDEAMTQFGMSRNGLLQLFRRVGVTEFEARYGTLPPASQRWDRILQASGMKRGKPSPTSAQTPDQASLHGFADSLERDLDAPSPMQEGDQTRASSRKRSRSDRAVTGPSAQQAVEVRVPEQRDALHLPLSWRVKRPRTRIGGGLPDPGTPMAADLAASSTVMWEQDADHFAGAADDFPAFNEEELAWLMELLPQ

SEQ ID NO: 118 - protein, 922 aa, Xanthomonas oryzae
MQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLTKAGELRGPPLQLDTGQLLKIAKRGGVTAVEAVHASRNALTGAPLNLTPDQVVAIASNSGGKQALEMVQRLLPVLCQDHGLTPDQVVAIASHGGGKQALETVQRLLPVLCQDHGLTPDQVVAIASNIGGKQALETVQRLLPVLCQDHGLTPDQVVATASNGGGKQALETVQRLLPVLCQDHGLAPDQVVAVASNSGGKQALETVQRLLPVLCQDHGLTPDQVVAIANNNGGKQALETVQRLLPVLCQDHGLTPDQVVAIASNGGGKQALETVQRLLPVLCQAHGLTPAQVVAIASNNGGKQALETVQRLLPVLCQDHGLTLDQVVAIASNGGSKQALETVQRLLPVLCQAHGLTLDQVVAIASHDGGKQALETVQRLLPVLCQDHGLTPDQVVAIANNNGGKQALETVQRLLPVLCQAHGLTRDQVVAIASHDGGKQALETVQRLLPVLCQDHGLTRDQVVAIASHDGGKQALETVQRLLPVLCQDHGLTPDQVVAIASNGGGKQALESIVAQLSRPDPALAALTNDHLVALACIGGRPALDAVKKGLPHAPEFIRRVNRRIAERTSHRVADYAHVVRVLEFFQCHSHPAHAFDEAMTQFGMSRNGLLQLFRRVGVTEFEARGGTLPPASQRWDRILQASGMKRGKPSPTSAQTPDQASLHAFADSLERDLDAPSPMQEGDQTRASSRKQSRSDRAVTGPSAQQAVEVRVPEQRDALHLPLSWSVKRPRTRIGGGLPDPGTPMAADLAASSTVMWEQDAAPFAGAADDFPAFNEEELAWLMELLPQ

SEQ ID NO: 119 - protein, 1347 aa, Xanthomonas oryzae
MPAVGTPHTAAAPAEWDEAQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIIRALPGATHEDIVGVGKQWSGARALEALLTDAGELRGPPLQLDTGQLLKIAKRGGVTAVEAVHASRNALTGAPLNLTPAQVVAIASNIGGKQALETVQRLLPVLCQDHGLTPDQVVAIASNGGGKQALETVQRLLPVLCQDHGLTPDQVVAIASNIGGKQALETVQRLLPGLCQAHGLTPDQVVAIASNGGGKQALETVQRLLPVLCQDHGLTPDQVVAIASNNGGKQALETVQQLLPVLCQDHGLTPDQVVAIASNGGGKQALETVQRLLPGLCQDHGLTPDQVVAIASNNGGKQALETVQRLLPVLCQAHGLTPDQVVAIASNGGGKQALETVQRLLPVLCQAHGLTPDQVVAIASHDGGKQALETVQRLLPVLCQDHGLTPDQVVAIANNNGGKQALETVQRLLPVLCQDHGLTPDQVVAIANNNGGKQALETVQRLLPVLCQDHGLTPDQVVAIASHGGGKQALETVQRLLPVLCQAHGLTPAQVVAIASHDGGKQALETVQRLLPVLCQDHGLTPDQVVAIASNNGGKQALETVQRLLPVLCQDHGLTPDQVVAIASNSGGKQALETVQRLLPVLCQAHGLTPDQVVAIANNNGGKQALETVQRLLPVLCQDHGLTPDQVVAIASHDGSKQALETVQRLLPVLCQDHGLTPDQVVAIASHDGSKQALETVQRLLPVLCQDHGLTPDQVVAIASNGGGKQALETVQRLLPVLCQDHGLTLDQVVAIASNAGGKQALETVQRLLPVLCQDHGLTPAQVVAIANNNGGKQALETVQRLLPVLCQDHGLTRDQVVAIASHDGGKQALETVQRLLPVLCQDHGLTPVQVVAIASHDGGKQALETVQRLLPVLCQAHGLTRDQVVAIASHDGGKQALETVQRLLPVLCQDHGLTPVQVVAIASHDGGKQALETVQRLLPVLCQDHGLTPAQVVAIASNGGKQALESIVAQLSRPDPALAALTNDHLVALACIGGRPALDAVKKGLPHAPELIRRINRRIPERTSHRVADLAHVVRVLEFFQCHSHPAHAFNEAMTQFGMSRNGLLQLFRRVGVTELEARGGTLPPASQRWDRILQASGMKRAKPSPTSAQTPDQASLHAFADSLERDLDAPSPMQEGDQTRASSRKQSRSDRAVTGPSAQQAVEVRVPEQRDALHLPLSWRVKRPRTRIGGGLPDPGTPMAADLAASSTVMWEQDAAPFAGAADDFPAFNEEELAWLMELLPQ

SEQ ID NO: 120 - protein, 1280 aa, Xanthomonas oryzae
MPAVGTPHTAAAPAEWDEAQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLTDAGELRGPPLQLDTGQLLKIAKRGGVTAVEAVHASRNALTGAPLNLTPAQVVAIASNNGGKQALETVQRLLPVLCQTHGLTPAQVVAIASHDGGKQALETVQRLLPVLCQDHGLTPDQVVAIASNSGGKQALETVQRLLPVLCQDHGLTPDQVVAIASNGGGKQALETVQRLLPVLCQDHGLTPDQVVAIASHDGGKQALETVQRLLPVLCQDHGLTPNQLVAIANNNGGKQALETVQRLLPVLCQDHGLTPDQVVAIASHDGGKQALETVQRLLPVLCQDHGLTPDQVVAIASNIGGKQALETVQRLLPVLCQDHGLTPAQVVAIASHDGGKQALETMQRLLPVLCQDHGLTPDQVVAIASNNGGKQALETMQRLLPVLCQDHGLTPAQVVAIVSHDGGKQALETVQRLLPVLCQTHGLTPDQVVAIASNNGGKQALETVQRLLPVLCQDHGLTPDQVVAIASHDGGKQALGTVQRLLPVLCQAHGLTPDQVVAIASNNGGKQALETVQRLLPVLCQDHGLTPDQVVAIASHDGGKQALETVQRLLPVLCQAHGLTPDQVVAIASNNGGKQALETVQRLLPVLCQAHGLTPDQVVAIANNNGGKQALETVQRLLPVLCQTHGLTPAQVVAIASNNGSKQALETVQRLLPVLCQTHGLTPAQVVAIASNNGGKQALETVQRLLPVLCQAHGLTPDQVVAIASNNGGKQALETVQRLLPVLCQAHGLTPAQVVAIASNNGGKQALETVQRLLPVLCQAHGLTPDQVVAIASNNGGKQALETVQRLLPVLCQDHGLTPAQVVAIASHDGGKQALETVQRLLPVLCQDHGLTPAQVVAIASNGGGKQALESIVAQLSRPDPALAALTNDHLVALACLGGRPALDAVKKGLPHAPELIRRVNSRIGERTSHRVADYAQVVRVLEFFQCHSHPAHAFDEAMTQFGMSRNGLLQLFRRVGVTELEARGGTLPPASQRWDRILQASGMKRAKPSCASAQTPDQASLHAFADSLERDLDAPSPMHEGDQTRASSRKRSRSDRAVTGPSAQQAVEVRVPEQRDALHLPLSWSVKRPRTRIGGGLPDPGTPMAADLAASSTVMWEQDADPFAGAADDFPAFNEEELAWLMELLPQ

SEQ ID NO: 121 - protein, 1074 aa, Xanthomonas oryzae
MPAVGTPHTAAAPAEWDEVQSGLRAAADPPPTVRVAVTAARPPRAKPAPRRRAAQPSDASPAAQVDLRTLGYSQQQQEKIKPNVRSTVAQHHEALVGHGFTHAHIVALSKHPAALGTVAVTYQHIITVLPEATHEDIVGVGKQWSGARALEALLTEAGELRGPPLQLDTGQLVKIAKRGGVTAVKAVHASRNALTGAPLNLTPAQVVAIASHHGGKQALETVQRLLPVLCQDHGLTLDQVVAIASNNGSKQALETVQRLLPVLCQDHGLTPDQVVAIASHDGGKQALETVQQLLPVLCQAHGLTPDQVMAIASHDGGKQALETVQRLLPVLCQAHGLTPDQVVAIASNGGGKQALETVQRLLPVLCQDHGLTPDQVVAIASNGGKQALETVQRLLPVLCQAHGLTPAQVVAIASHDGGKQALETVQRLLPVLCQAHGLTPDQVVAIANNNGGKQALETVQRLLPVLCQAHGLTPDQVVAIASHDGGKQALETVQRLLPVLCQAHGLTPYQVVAIASNDGSKQALETVQRLLPVLCQDHGLTPAQVVAIASNGGKQALETVQRLLPVLCQAHGLTLDQVVAIASNGGGKQALETVQRLLPVLCQAHGLTPAQVVAIASNSGGKQALETVQRLLPVLCQDHGLTPAQVVAIASNSGGKQALETVQRLLPVLCRDHGLTPDQVVAIANNNGGKQALETVQRLLPVLCQAHGLTPDQVVAIASHDGGKQALETVQRLLPVLCQDHGLTPAQVVAIASHDGGKQALETVQRLLPVLCQTHGLTPAQVVAIASNGGGKQALESIVAQLSRPDPALAALTNDHLVALACLGGRPALDAVKKGLPHAPEFIRRVNRRIPERTSHRVADYAHVVRVLEFFQCHSHPAHAFDEAMTQFGMSRHGLVQLFRRVGVTEFEARYGTLPPASQRWDRILQASGMKRAKPSPTSAQTPDQAFLHAFADSLERDLDAPSPMHEGDQTRASSRKRSRSDRAVTGPSAQQAVEVRVPEQRDALHLPLSWSVKRPRTRIWGGLPDPGTPMAADLAASSTVMWEQDVDHFAGAADDFPAFNEEELAWLMELLPQ

SEQ ID NO: 122 - protein, 1143 aa, Xanthomonas oryzae
MPAVGTPHTAAAPAEWDEVQSALRAADDPPPTVRVAVTAARQPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLADAGELRGPPLQLDTGQLVKIAKRGGVTAVEAVHASRNALTGAPLNLTPAQVVAIASNNGGKQALETVQWLLPVLCQAHGLSPDQVVAIASHDGGKQALETVQRLLPVLCQAHGLTPAQVVAIASNIGGKQALETVQRLLPVLCQDHGLPPDQVVAIASNIGGKQALETVQRLLPVLCQAHGLTPAQVVAIASNNGGKQALETVQRLLPVLCQAHGLTPAQVVAIASHAGGKQALETVQRLLPVLCQAHGLTPAQVVAIASNNGGKQALETVQRLLPVLCQAHGLTPAQVVAIASNSGGKQALETVQRLLPVLCQAHGLTPAQVVAIASNSGGKQALETVQRLLPVLCQAHGLTPAQVVAIASNIGGKQALETVQRLLPVLCQAHGLTPAQVVAIASHDGGKQALETVQRLLPVLCQDHGLTPDQVVAIASHAGGKQALETVQRLLPVLCQAHGLTPAQVVAIASHAGGKQALETVQRLLPVLCQAHGLTPAQVVAIASHAGSKQALETVQRLFPVLCQAHGLTPAQVVAIASHDGGKQALETVQRLLPVLCQAHGLIPAQVVAIASHDGGKQALETVQRLLPVLCQAHGLTPAQVVAIASHDGGKQALETVQRLLPVLCQDHGLIPAQVVAIASHAGGKQALETVQRLLPVLCQDHGLTPAQVVAIASHDGGKQALETVQRLLPVLCQDHGLTPDQVVAIASNGGKQALESIVAQLSRPDPALTALTNDHLVALACLGGRPALDAVKKGLPHAPNLIRRVNSRIGERTSHRVADYAQVVRVLEFFQCHSHPAHAFDEAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTGPSAQQAVEVRVPEQRDALHLPLSWRVKRPRTRIGGGLPDPGTPMAADLAASSTVMWEQDADPFAGAADDFPAFNEEELAWLRELLPQ

SEQ ID NO: 123 - protein, 1077 aa, Xanthomonas oryzae
MPAVGTPHNTAAAPAEWDEAQSGLRAADDPPPTVRVAVTAARPPRAKPAPRRRAAQSSDASPAAQVDLRTLGYSQQQQEKIEPNVRSTVAQHHEALVGHGFTHAHIVALSRHPAALGTVAVTYQHIITALPEATHEDIVGVGKQWSGARALEALLTKAGELRGPPLQLDTGQLVKIARRGGVTAVEAVHASRNALTGAPLNLTPAQVVAIASNNGGKQALETVQRLLPVLCQAHGLTPDQVVAIASHDGGKQALETVQRLLPVLCQAHGLTPDQVVAIASHDGGKQALETVQRLLPVLCQAHGLTPDQVVAIASHHGGKQALETVQRLLPVLCQDHGLTPAQVVAIASNNGGKQALETVQRLLPVLCQAHGLTPDQVVAIASNGGGKQALETVQRLLPVLCQDHGLTPAQVVAIASNSGGKQALETVQRLLPVLCQAHGLTPDQVVAIASNGGGKQALETVQRLLPVLCQAHGLTPDQVVVIASHDGGKQALETVQRLLPVLCQAHGLTPDQVVAIASNIGGKQALETVQRLLPVLCQAHGLTLDQVVAIASNGGSKQALETVQRLLPVLCQDHGLTPDQVVAIASHDGGKQALETVQRLLPVLCQDHGLTPDQVVAIASHHGSKQALETMQRLLPVLCQDHGLTPDQVVTIASNGGGKQALETVQRLLPVLCQDHGLTPDQVVAIASNGGGKQALETVQRLLPVLCQDHGLTLDQVVAIASNGGGKQALETVQRLLPVLCQEHGLSQDQVVAIASHAGGKQALETVQRLLPVLCQDHGLTPAQVVAIASNGGGKQALESIVAQLSRPDPALAALTNDHLVALACLGGRPALDAVKKGLPHAPELIRRVNSRIGERTSHRVADYAHVVRVLEFFQCHSHPAHAFDEAMTQFGMSRHGLVQLFRRVGVTEFEARCGTLPPASQRWDRILQASGMKRAKPSPTSAQTPDQASLHGFADSLERDLDAPSPMHEGDQTRASSRKRSRSDHAVTGPSAQQAVEVRVPEQRDALHLPLSWSVKRPRTRIGGGLPDPGTPMAADLAASSTVMWEQDAAPFAGAADDFPAFNEEELAWLMELLPQ

SEQ ID NO: 124 - protein, 1125 aa, Xanthomonas oryzae
MQSALRAADDPPPTVRVAVTAARPPRAKPAPRRRAAQPSDALPAAQVDLRTLGYSQQQQEKIKPKVRSTVAQHHEALVGHGFTHAHIVALSQHPAALGTVAVTYQHIITALPEATHEDIVGVGKQWSGARALEALLTDAGELRGPPLQLDTGQLLKIAKRGGVTAVEAVHASRNALTGAPLNLTPAQVVAIASNNGGKQALETVQRLLPVLCQDHGLTPDQVVAIASNGGGKQALETVQRLLPVLCQDHDLTPDQVVAIASHDGGKQALETVQRLLPVLCQDHGLTPDQVVAIASNGGGKQALETVQRLLPVLCQDHGLTPDQVVAIASHDGGKQALETVQRLLPVLCQDHGLTPDQVVAIASHDGGKQALETVQRLLPVLCQDHGLTPDQVVAVAGNIGGKQALETVQRLLPVLCQDHGLTPDQVVAIANNHGGKQALETVQRLLPVLCQDHGLTPDQVVAIASHGGGKQALETVQRLLPVLCQAHGLTPDQVVAIASNIGGKQALETVQRLLPVLCQAHGLTPDQVVAIANNNGGKQALETVQRLLPVLCQEHGLTLDQVVSIASNNGGKQALETVQRLLPVLCQDHGLTPDQVVAIASHDGGKQALETVQRLLPVLCQDHGLTPDQVVAIANNSGGKQALETVQRLLPVLCQDHGLTLAQVVAIASNGGGKQALETVQRLLPVLCQDHGLTPAQVVAIANNNGGKQALETVQRLLPVLCQAHGLTPAQVVAIASHDGGKQALETVQRLLPVLCQDHGLTPDQVVAIASNGGGKQALETVQRLLPVLCQDHGLTPDQVVAIASNGGGKQALETVQRLLPVLCQDHGLTPDQVVAIASNGGKQALESIVAQLSRPYPALTALTNDHLVALACLGGRPALDAVKKGLPHAPELIRRINRRIPERTSHRVADYAQVVRVLEFFQCHSHPAQAFDDAMTQFGMSRQGLVQLFRRVGVTEFEARYGTLPPASQRWDRILQASGMKRAKPSCASAQTPDQASLHGFADSLERDLDAPSPMHEGEQTRASSRKRSRSDRAVTGPSAQQAVEVRVPEQRDALHLPLSWSVKRPRTRIGGGLPDPGTPMAADLAASSTVMWEQDADHFAGAADDFPAFNEEELAWLMELLPQ

SEQ ID NO: 125 - protein, 1004 aa, Xanthomonas oryzae
MPAVGTPHTAAAPAEWDEAQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLTDAGELRGPPLQLDTGQLVKIAKRGGVTAVEAVHASRNALTGAPLNLTPAQVVAIASNIGGKQALETVQRLLPVLCQDHGLTPDQVVAIANNNGGKQALETVQRLLPVLCQAHGLTPDQVVAIASHNGGKQALETVQRLLPVLCQDHGLTPDQVVAIASNNGGKQALETVQRLLPVLCQAHGLIPDQVVAIASNIGGKQALETVQRLLPVLCLTPAQVVAIASNGGGKQALETVQRLLPVLCQDHGLTPDQVVAIASHDGGKQALETVQRLLPVLCQDHGLTPDQVVAIASNNGGKQALETVQRLLPVLCQAHGLTPAQVVAIASHDGGKQALETVQRLLPVLCQAHGLTPAQVVAIASHGGGKQALETVQRLLPVLCQAHGLTPAQVVAIASHDGGKQALETVQRLLPVLCQAHGLTPDQVVAIASHGGGKQALETVQRLLPVLCQAHGLTPDQVVAIASHGGGKQALETVQRLLPVLCQDHGLTPAQVVAIASHDGGKQALETVQRLLPVLCQDHGLTPAQVVAIASHDGGKQALETVQRLLPVLCQDHGLTPDQVVAIASNGGGKQALESIVAQLSRPDPALAALTNDHLVALACLGGRPALDAVKKGLPHAPELIRRVNSRIGERTSHRVADYAQVVRVLEFFQCHSHPAHAFDEAMTQFGMSRQGLLQLFRRVGVTELEARGGTLPPASQRWHRILQASGMKRAEPSPTSAQTPDQASLHAFADSLERDLDAPSPMHEGDQTRASSRKRSRSDRAVTGPSAQQAVEVRVPEQRDALHLPLSWSVKRPRTRIGGGLPDPGTPMAADLAASSTVMWEQDADPFAGAADDFPAFNEEELAWLMELLPQ

SEQ ID NO: 126 - protein, 1158 aa, Xanthomonas oryzae
MQSALRAADDPPPTVRVAVTAARPPRAKPAPRRRAAQPSDASPAAQVDLRTLGYSQQQQEKIKPNVRSTVAQHHEALVGHGFTHAHIVALSQHPAALGTVAVTYQHIITALPEATHEDIVGVGKQWSGARALEALLTDAGELRGPPLQFDTGQLLKIAKRGGVTAVEAVHASRNALTGAPLNLTPAQVVAIASNNGGKQALETVQRLLPVLCQAHGLTPDQVVAIASNSGGKQALETVQRLLPMLCQDHGLTPDQVVAIASNGGGKQALETVQRLLPVLCQDHGLTPDQVVAIASNIGSKQALETVQRLLPVLCQAHGLTPDQVVATASHDGGKQALETVQRLLPVLCQDHGLTPDQVVAIASHDGGKQALETVQRLLPVLCQDHGLTPDQVVAIASNGGGKQALETVQRLLPVLCQAHGLTPTQVVAIASNNGGKQALETVQRLLPVLCQDHGLTPDQVVAIASHDGGKQALETVQRLLPVLCQAHGLTLAQVVAIASNIGGKQALETVQRLLPVLCQDHGLTPDQVVAIASNGGGKQALETVQRLLPALCQDHGLTPDQVVAIASNGGKQALETVKRLLPVLCQAHGLTPDQVVAIASNGGKQALETVQRLLPVLCQDHGLTPDQVVAIASNGGGKQALETVQRLLPVLCQDHGLTPDQVVAIASHDGGKQALETVQRLLPVLCQAHGLTPDQVVAIASHDGGKQALETVQRLLPVLCQAHGLTPAQVVAIASNSGGKQALETVQRLLPVLCQAHGLTPDQVVAIASNIGGKQALETVQRLLPVLCQDHGLTPAQVVAIASNNGGKQALETVQRLLPVLCQDHGLTLDQVVAIASNGGSKQALETVQRLLPVLCQTHGLTPAQVVAIASNGGGKQALESIVAQLSRPDPALAALTNDHLVALACLGGRPALDAVKKGLPHAPEFIRRVNSRIAERTSHRVADYAQVVRVLEFFQCHSHPAQAFDDAMTQFGMSRHGLVQLFRRVGVTEFEARYGTLPPASQRWDRILQASGMKRAKPSPTSAQTPDQTSLHAFADSLERDLDAPSPMHEGDQTRASSRKRSRSDRAVTGPSAQQAVEVRVPEQRDALHLPLSWRVKRPRTRIGGGLPDPGTPIAADLAASSTVMWEQDVDHFAGAADDFPAFNEEELAWLRELLPQ

SEQ ID NO: 127 - protein, 1022 aa, Xanthomonas oryzae
MQSALRAADDPPPTVRVAVTAARPPRAKPAPRRRAAQPSDASPAAQVDLRTLGYSQQQQEKIKPNMRSTVAQHHEALVGHGFTHAHIVALSQHPAALGTVAVTYQHIITALPEATHEDIVGVGKQWSGARALEALLTKAGELRGPPLQLDTGQLLKIAKRGGVTAVEAVHAWRNALTGAPLNLTPAQVVAIASHDGGKQALETVQRLLPVLCQAHGLTPDQVVAIASHGGGKQALETVQRLLPVLCQAHGLTPAQVVAIASHDGGKQALETVQRLLPVLCQAHGLTPDQVVAIASHGGGKQALETVQRLLPVLCQAHGLTPDQVVAIASNGGKQALETVQRLLPVLCQDHGLTPDQVVAIANNNGGKQALETLQRLLPVLCQDHGLTPDQVVAIASNGGGKQALETVQRLLPVLCQAHGLTPDQVVAIASHDGGKQALETVQRLLPVLCQDHGLTPDQVVAIANNNGGKQAVETVQRLLPVLCQAHGLTPNQVVAIASHDGGKQALETVQRLLPVLCQDHGLTPDQVVAIASNGGGKQALETVQRLLPVLCQAHGLTLTQVVAIASNGGGKQALETVQRLLPVLCQAHGLTPDQVVAIANNNGGKQALETVQRLLPVLCQAHGLTPDQVVAIASHDGGKQALETVQRLLPVLCQAHGLTPAQVVAIASNGGKQALETVRRLLPVLCQAHGLTPDQVVAIASNGGGKQALETVQRLLPVLCQDHGLTPDQVVAIASNGGGKQALESIVAQLSRRDPALAALTNDHLVALACLGGRPALDAVKKGLPHAPEFIRRVNRRIAERTSHRVADYAHVVRVLEFFQCHSHPAQAFDDAMTQFGMSRHGLVQLFRRVGVTEFEARYGTLPPASQRWDRILQASGMKRAKPSPTSAQTPDQTSLHAFADSLERDLDAPSPMHEGDQTRASSRKRSRSDRAVTGPSAQQAVEVRVPEQRDALHLPLSWRVKRPRTRIGGGLPDPGTPIAADLAASSTVMWEQDVDHFAGAADDFPAFNEEELAWLRELLPQ

SEQ ID NO: 128 - protein, 1076 aa, Xanthomonas oryzae
MPAVGTPHTAAAPAEWDEVQSALRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLTDAGELRGPPLQLDTGQLVKIAKRGGVTAMEAVHASRNALTGAPLNLTPAQVVAIASHDGGKQALETVQRLLPVLCQDHGLPPDQVVAIASHDGGKQALETVQRLLPVLCQDHGLPPDQVVAIASHDGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGGKQALETLQRLLPVLCQAHGLTPAQVVAIASHDGGKQALETVQRLLPMLCQAHGLTPDQVMAIASNNGGKQALETVQRLLPVLCQDHGLTPDQVVAIASHDGGKQALETVQRLLPVLCQDHGLTLAQVVAIASNDGGKQALETVQRLLPVLCQAHGLTPAQVVAIASNGGGKQALETVQRLLPVLCQAHGLTLDQVVAIASNGGGKQALETVQRLLPVLCQAHGLTPAQVVAIASNNGGKQALETVQRLLPVLCQDHGLTPAQVVAIASHGGGKQALETVQRLLPVLCQDHGLTPDQVVAIASNDGGKQALETVQRLLPVLCQDHGLTPDQVVAIASNDGGKQALETVQRLLPVLCQDHGLTPDQVVAIASHDGGKQALETVQRLLPVLCQTHGLTPAQVVAIASNGGGKQALESIVAQLSRPDPALAALTNDHLVALACLGGRPALDAVKKGLPHAPEFIRRVNSRIAERTSHRVADYAQVVRVLEFFQCHSHPAHAFDEAMTQFGMSRHGLVQLFRRVGVTEFEARYGTLPPASQRWDRILQASGMKRAKPSPTSAQTPDQASLHAFADSLERDLDAPSPMQEGDQTRASSRKRSRSDRAVTGPSAQQAVEVRVPEQRDALHLPLSWRVKRPRTRIWGGLPDPGTPMAADLAASSTLMWEQDVDHFAGAADDFPAFNEEELAWLRELLPQ

SEQ ID NO: 129 - protein, 1091 aa, Xanthomonas oryzae
MQSALRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQHIITALPEATHEDIVGVGKQWSGARALEALLTKAGELRGPPLQLDTGQLVKIAKRGGVTAVEAVHAWRNALTGAPLNLTPDQVVAIASHDGGKQALETVQRLLPVLCQAHGLTPDQVVAIASNNGSKQALETVQRLLPVLCQDHGLTPAQVVAIASHDGGKQALETVQRLLPVLCQAHGLPPDQVVAIASNGGKQALETVQRLLPVLCQDHGLTPDQVVAIASNSGGKQALETVQRLLPVLCQDHGLTPDQVVAIASNNGGKQALETVQRLLPVLCQAHGLTPDQVVAIASHGGGKQALETVQRLLPVLCQDHGLTPDQVVAIASNIGGKQALETVQRLLPVLCQAHGLTPAQVVAIASNIGGKQALETVQRLLPVLCQAHGLTPDQVVAIASNSGGKQALETVQRLLPVLCQDHGLTPDQVVAIASNIGGKQALETVQRLLPVLCQAHGLTLDQVVAIASNGGSKQALETVQRLLPVLCQAHGLTPAQVVAIASHDGGKQALETVQRLLPVLCQAHGLTPAQVVAIASNNGGKQALETVQRLLPVLCQAHGLTPDQVVAIASHDGGKQALETVQRLLPVLCQAHGLTPDQVVAIASHDGGKQALETVQRLLPVLCQAHGLTPAQVVAIASNGGGKQALETVQRLLPVLCQDHGLTPDQVVAIASHGGGKQALETVQRLLPVLCQDHGLTPDQVVAIASNGGGKQALESIVAQLSRPDPALAALTNDHLVALACLGGRPALDAVKKGLPHAPEFIRRVNRRIGERTSHRVADYAHVVRVLEFFQCHSHPAHAFDEAMTQFGMSRNGLLQLFRRVGVTELEARCGTLPPASQRWDRILQASGMKRAKPSPTSAQTPDQASLHAFADSLERDLDAPSPMHEGDQTRASSRKRSRSDRAVTGPSAQQAVEVRVPEQRDALHLPLSWSVKRPRTRIGGGLPDPGTPMAADLAASSTVMWEQDAAPFAGAADDFPAFNEEELAWLMELLPQ

SEQ ID NO: 130 - protein, 1124 aa, Xanthomonas oryzae
MQSALRAADDPPPTVCVAVTAARPPRAKPAPRRRAAQPSDASPAAQVDLRTLGYSQQQREKIKPNVRSTVAQHHEALVGHGFTHAHIVALSQHPAALGTVPVTYQHIITALPEATHEDIVGVGKQWSGARALEALLTDAGELRGPPLQLDTGQLLKIAKRGGVTAVEAVHASRNALTGAPLNLTPDQVVAIASNSGGKQALEMVQRLLPVLCQAHGLTPAQVVAIASHDGGKQALETVQRLLPVLCQAHGLTPDQVVAIASNIGGKQALETVQRLLPVLCQAHGLTPDQVVAIASNGGKQALETVQRLLPVLCQAHGLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQDHGLTLAQVVAIASNIGGKQALETVQRLLPVLCQAHGLTPDQVVAIASNGGKQALETVQRLLPVLCQAHGLTPDQVVAIASNGGGKQALETVQRLLPVLCQDHGLTPDQVVAIASHDGGKQALETVQRLLPVLCQDHGLTPDQVVAIANNNGGKQALETLQRLLPVLCQAHGLTPAQVVAIASNIGGKQALETVQRLLPVLCQAHGLTPDQVVAIASNGGSKQALETVQRLLPVLCQDHGLTPDQVVAIASHDGGKQALETVQRLLPVLCQDHGLTPAQVVAIANNNGGKQALETVQRLLPVLCQDHGLSPAQVVAIASNSGGKQALETVQRLLPVLCHDHGLTPAQVVAIANNNGGKQALETVQRLLPVLCQDHGLTPAQVVAIASNGGGKQALETVQRLLPVLCQDHGLTPDQVVAIASNNGGKQALESIVAQLSRPDPALAALTNDHLVALACLGGRPALDAVKKGLPHAPELIRRVNSRIGERTSHRVADYAQVVRVLEFFQCHSHPAHAFDEAMTQFGMSRNGLLQLFRRVGVTELEARGGTLPPASQRWHRILQASGMKRAEPSPTSAQTPDQASLHAFADSLERDLDAPSPMHEGDQTRASSRKRSRSDRAVTGPSAQQAVEVRVPEQRDALHLPLSWRVKRPRTRIGGGLPDPGTPMAADLAASSTVMWEQDAAPFAGAADDFPAFNEEELAWLRELLPQ

SEQ ID NO: 131 - protein, 1175 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVEAVHAWRNALTGAPLNLTPDQVVAIASNIGGNQALETVQRLLPVLCQAHGLTPDQVVAIASHGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIANNNGGKQALETVQRLLPVLCQDHGLTPDQVVAIASHDGGKQALETVQRLLPVLCQGHGLTPDKVVAIASNSGGKQALETVQRLLPVLCQAHGLTPDKVVAIANNNGGKQGKQALETVQRLLPVLCQDHGLTPDQVVAIASNSGGKQALETVQRLLPVLCQDHGLTPAQVVAIANNNGGKQALETVRRLLPVLCQDHGLTPDQVVAIASHDGGKQALETVQRLLPVLCQDHGLTPDQVVAIANNNGGKQALETVQRLLPVLCQNHGLTPDQVVAIASNIGGKQALETVQRLLPVLCQDHGLTPDQVVAIASHDGGKQALETVQRLLPVLCQDHGLTPAQVVAIANNNGGKQALETVRRLLPVLCQDHGLSPDQVVAIASNSGGKQALETVQRLLPVLCQDHGLTPAQVVAIASNGGGKQALESIVAQLSRPDPALAALTNDHLVALACLGGRPALDAVKKGLPHAPELIRRINRRIPERTSHRVADYAQVVRVLEFFQCHSHPAYAFDEAMTQFGMSRNGLLQLFRRVGVTELEARGGTLPPASQRWDRILQASGMKRAKPSPTSAQTPDQASLHAFADSLERDLDAPSPMHEGDQTGASSRKRSRSDRAVTGPSAQQSFEVRVPEQHDALHLPLSWRVKRPRTRIGGGLHDPGTPIAADLAASSTVMWEQDAAPFAGAADDFPAFNEEELAWLMELLPQSGSVGGTI

SEQ ID NO: 132 - protein, 1037 aa, Xanthomonas oryzae
MTAVEAVHAWRNALTGAPLNLTPDQVVAIASNIGGKQALETVQRLLPVLCQDHGLTPDQVVAIARNGGGKQALETVQRLLPVLCQDHGLTPDQVVAIASNIGGKQALETVQRLLPVLCQDHGLTPDQVVAIASNIGGKQALATVQRLLPVLCQAHGLTPDQVVAIASNGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGKQALETVQRLLPVLCQDHGLTLAQVVAIASNIGGKQALETVQRLLPVLCQDHGLTPDQVVAIASNIGGKQALETVQRLLPVLCQDHGLTPDQVVAIASNIGGKQALETVQRLLPVLCQAHGLTPDQVVAIASNGGGKQALETVQRLLPVLCQDHGLTPDQVVAIASHDGGKQALETVQRLLPVLCQDHGLTPDQVVAIASHGGGKQALETVQRLLPVLCQDHGLTPDQVVAIANNNGGKQALETVQRLLPVLCQDHGLTPAQVVAIASNSGGKQALETVQRLLPVLCQDHGLTPDQVVAIANNNGGKQALEMVQRLLPVLCQDHGLTPDQVVAIASHDGGKQALETVQRLLPVLCQDHGLTLDQVVAIASHDGGKQALETVQRLLPVLCQDHGLTPDQVVAIASNGGGKQALETVQRLLPVLCQDHGLTPAQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFEMSRHGLVQLFRRVGVTEFEARYGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 133 - protein, 1267 aa, Xanthomonas oryzae
MQSGLRAADDPPPTVRVAVTAARPPRAKPAPRRRAAQPSDASPAAQVDLRTLGYSQQQQEKIKPKVGSTVAQHHEALVGHGFTHAHIVALSRHPAALGTVAVKYQDMIAALPEATHEDIVGVGKQWSGARALEALLTVAGELRGPPLQLDTGQLVKIAKRGGVTAVEAVHASRNALTGAPLNLTPAQVVAIASNNGGKQALETVQRLLPVLCQAHGLTPAQVVAIASHDGGKQALETMQRLLPVLCQAHGLPPDQVVAIASNIGGKQALETVQRLLPVLCQAHGLTPDQVVAIASHGGGKQALETVQRLLPVLCQAHGLTPDQVVAIASHDGGKQALETVQRLLPVLCQAHGLTPDQVVAIASNGGGKQALETVQRLLPVLCQAHGLTPDQVVAIASNGGKQALETVQRLLPVLCQAHGLTPDQVVAIASHDGGKQALETVQRLLPVLCQTHGLTPAQVVAIASHDGGKQALETVQQLLPVLCQAHGLTPDQVVAIASNIGGKQALATVQRLLPVLCQAHGLTPDQVVAIASNGGGKQALETVQRLLPVLCQAHGLTPDQVVAIASNGGGKQALETVQRLLPVLCQAHGLTQVQVVAIASNIGGKQALETVQRLLPVLCQAHGLTPAQVVAIASHDGGKQALETVQRLLPVLCQAHGLTPDQVVAIASNGGGKQALETVQRLLPVLCQAHGLTQEQVVAIASNNGGKQALETVQRLLPVLCQAHGLTPDQVVAIASNGGGKQALETVQRLLPVLCQAHGLTPAQVVAIASNIGGKQALETVQRLLPVLCQDHGLTLAQVVAIASNIGGKQALETVQRLLPVLCQAHGLTQDQVVAIASNIGGKQALETVQRLLPVLCQDHGLTPDQVVAIASNIGGKQALETVQRLLPVLCQDHGLTLDQVVAIASNGGKQALETVQRLLPVLCQDHGLTPDQVVAIASNSGGKQALETVQRLLPVLCQDHGLTPNQVVAIASNGGKQALESIVAQLSRPDPALAALTNDHLVALACLGGRPAMDAVKKGLPHAPELIRRVNRRIGERTSHRVADYAQVVRVLEFFQCHSHPAYAFDEAMTQFGMSRNGLVQLFRRVGVTELEARGGTLPPASQRWDRILQASGMKRAKPSPTSAQTPDQASLHAFADSLERDLDAPSPMHEGDQTGASSRKRSRSDRAVTGPSAQHSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 134 - protein, 1068 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIITALPEATHEDIVGVGKQWSGARALEALLTEARELRGPPLQLDTGQLLKIAKRGGVTAVEAVHAWRNALTGAPLNLTPDQVVAIASNIGGKQALETVQRLLPVLCQDHGLTPDQVVAIASNGGGKQALETVQRLLPVLCQAHGLTPDQVVAIASNNGGKQALETVQRLLPVLCQDHGLTPDQVVAIASNGGGKQALETVQRLLPVLCQDHGLTPDQVVAIANNKGGKQALETLQRLLPVLCQAHGLTPDQVVAIASNGGGKQALETVQRLLPVLCQDHGLTPAQVVAIASNIGGKQALETVQRLLPVLCQDHGLTPDQVVAIANNNGGKQALETVQRLLPVLCQDHGLTPDQVVTIASNIGGKQALEMVQRLLPVLCQDHGLTPDQVVAIANNNGGKQALETVQRLLPVLCQAHGLTPDQVVAIASNIGGKQTLETVQRLLPVLCQDHGLTPDQVVAIASHDGGKQALETVQRLLPVLCQDHGLTLDQVVAIASNGGKQALETVQRLLPVLCQDHGLTPDQVVAIASNSGGKQALETVQRLLPVLCQDHGLTPNQVVAIASNGGKQALESIVAQLSRPDPALAALTNDHLVALACLGGRPALDAVKKGLPHAPELIRRINRRIPERTSHRVPDLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTDPSTQQSFEVRVPEQRDALHLPLSWRVKRPRTRIGGGLPDPGTPIAADLAASSTVLWEQDAAPFAGAADDFPAFNEEELAWLMELLPQSGSVGGTI

SEQ ID NO: 135 - protein, 623 aa, Xanthomonas oryzae
MQRLLPVLCQAHGLTPDQVVAIASHDGGKQALETVQRLLPVLCQAHGLTPAQVVAIASHDGGKQALETVQRLLPVLCQAHGLTLDQVVAIASNGGGKQALETVQRLLPVLCQAHGLTPDQVVAIASHDGGKQALETVQRLLPVLCQDHGLTPAQVVAIASNNGGKQALETVQRLLPVLCQAHGLTLDQVVAIASNGGGKQALETVQRLLPVLCQAHGLTPDQVVAIASHDGGKQALETVQRLLPVLCQDHGLTPAQVVAIASNNGGKQALETVQRLLPVLCQAHGLTPDQVVAIASHDGGKQALETVQRLLPVLCQAHGLTPDQVVAIASNGGGKQALETVQRLLPVLCQAHGLTPDQVVAIASHDGGKQALETVQRLLPVLCQDHGLTPDQVVAIASNIGGKQALETVQRLLPVLCQDHGLTPDQVVAIASNGGKQALESIVAQLSRPDPALAALTNDHLVALACLGGRPALDAVKKGLPHAPELIRRVNSRIGERTSHRVADLAHVVRVLGFFQSHSHPAQAFDDAMTQFGMSRHGLVQLFRRVGVTEFEARCGTIPPASQRWDRILQASGTKRAKPSPTSAQTPDQASLHAFPDSLERDLDAPSPMHEGDQTRASRRKRS

SEQ ID NO: 136 - protein, 653 aa, Xanthomonas oryzae
MTAVEAVHAWRNALTGAPLNLTPDQVVAIASNSGGKQALETVQRLLPVLCQDHGLTPDQVVAIASHDGGKQALETVQRLLPVLCQDHGLTPDQVVAIASNGGGKQALETVQRLLPVLCQDHGLTPDQVVAIASNGGGKQALETVLCQAHGLTPAQVVAIASNGGGKQALETVQRLLPVLCQAHGLTLDQVVAIASNGGGKQALETVQRLLPVLCQAHGLTPAQVVAIASNGGGKQALETVQRLLPVLCQAHGLTPAQVVAIASHDGGKQALETVQRLLPVLCQAHGLTLDQVVAIASHDGGKQALETVQRLLPVLCQAHGLTLDQVVAIASHDGGKQALETVQRLLPVLCQDHGLTPAQVVAIASNNGGKQALETVQRLLPVLCQDHGLTPDQVVAIASHDGGKQALETMQRLLPVLCQAHGLTPDQVVAIASNGGGKQALETVQRLLPVLCQAHGLTPDQVVAIASHDGGKQALETVQRLLPVLCQDHGLTPDQVVAIASHDGGKQALETVQRLLQVLCQDHGLTPDQVVAIASHDGGKQALETVQRLLPVLCQDHGLTPDQVVAIASHDGGKQALETVQRLLPVLCQDHGLTPDQVVAIASNGGKQALESIVAQLSRRDPALAALTNDQLVALACLGGRPAPHSRKRKSHD

SEQ ID NO: 137 - protein, 811 aa, Xanthomonas oryzae
MVAIASNIGGKQALETVQRLLPVLCQAHGLTPDQVVAIANNNGGKQALETVQRLLPVLCQAHGLTPAQVVAIASNNGGKQALETVQRLLPVLCQDHGLTPDQVVAIASNIGGKQALETVQRLLPVLCQDHGLTPDQVVAIASNIGGKQALETVQRLLPVLCQTHALTPDQVVAIASNIGGKQALETVQRLLPVLCQDHGLTPAQVVAIASHDGGKQALETVQRLLPVLCQDHGLTPDQVVAIASNSGGKQALETVQRLLPVLCQAHGLTLDQVVAIASHGGGKQALETVQRLLPVLCQDHGLTPDQVVAIASNNGGKQALETVQRLLPVLCQDHGLIPDQVVAIANNNGGKQALETVQRLLPVLCQAHGLTTDQVVTIASNNGGKQALETVQRLLPVLCQDHGLTPDQVVAIASNIGGKQALETVQRLLPVLCQDHGLTLDQVVAIASNIGGKQALETVQRLLPVLCQDHGLTPDQVVAIASHGGGKQALETVQRLLPVLCQDHGLTPDQVVAIASHDGGKQALESIVAQLSRPDPALAALTNDHLVALACLGGRPALDAVKKGLPHAPELIRRINRRIPERTSHRVADYAQVVRVLEFFQCHSHPAYAFDEAMTQFGMSRNGLVQLFRRVGVTELEARGGTLPPASQRWDRILQASGMKRAKPSPTSAQTPDQASLHAFADSLERDLDAPSPMHEGDQTGASSRKRSRSDRAVTGPSAQQSFEVRVPEQHDALHLPLSWRVKRPRTRIGGGLPDPGTPIAADLAASSTVMWEQDAAPFAGAADDFPAFNEEELAWLMELLPQSGSVGGTI

SEQ ID NO: 138 - protein, 1047 aa, Xanthomonas oryzae
MVAIASNIGGNQALETVQRLLPVLCQDHGLTPDQVVAIASHGGKQALETVQRLLPVLCQDHGLTPDQVVAIASNIGGKQALETVQRLLPVLCQDHGLTPAQVVAIASNNGGKQALETVQRLLPVLCQAHGLTPDQVVAIASNNGGKQALETVQRLLPVLCQAHGLTPDQVVAIANNNGGKQALETVQRLLPVLCQDHGLSPDQVVAIANNNGGKQALETLQRLLPVLCQTHALTPDQVVAIANNNGGKQALETVQRLLPVLCQDHGLTPDQVVAIASHDGGKQALETVQRLLPVLCQDHGLTPDQVVAIASNIGGKQALETVQRLLPVLCQDHGLTPDQVVAIASHDGGKQALETVQRLLPVLCQDHGLTPAQVVAIASHGGGKQALETVQRLLPVLCQAHGLTPDQVVAIASHDGGKQALETVQRLLPVLCQAHGLTPNQVVAIASNIGGKQALETVQRLLPVLCQDHGLTPDQVVAIASNGGKQALETVQRLLPVLCQAHGLTPDQVVAIASNSGGKQALETVQRLLPVLCQDHGLTPNQVVAIASNIGGKQALETVQRLLPVLCQDHGLTPDQVVAIASNIGGKQALETVQRLLPVLCQDHGLTLDQVVAIASHGGGKQALETVQRLLPVLCQDHGLTSDQVVAIASHDGGKQALETVQRLLPVLCQDHGLTPDQVVAIASNSGGKQALETVQRLLPVLCQDHGLTPAQVVAIASNSGGKQALETVQRLLPVLCQAHGLTPNQVVAIASNGGGKQALESIVAQLSRPDPALAALTNDHLVALACLGGRPALDAVKKGLPHAPNLIRRVNSRIGERTSHRVADLAQVVRVLEFFQCHSHPAHAFDEAMTQFGMSRNGLLQLFRRVGVTELEARGGTLPPASQRWDRILQASGMKRAKPSPTSAQTPDQASLHAFADSLERDLDALSPMHEGDQTRASSRKRSRSDRAVTGPSAQQSFEVRVPEQHDALHLPLSWRVKRPRTRIGGGLPDPGTPIAADLAASSTVMWEQDAAPFAGAADDFPAFNEEELAWLMELLPQSGSVGGTI

SEQ ID NO: 139 - protein, 810 aa, Xanthomonas oryzae
MVAIASNIGGKQALETVQRLLPVLCQAHGLTPDQVVAIASNSGGKQALETVQRLLPVLCQDHGLTPDQVVAIASHDGGKQALETVQRLLPVLCQAHGLTPDQVVAIASHGGGKQALETVQRLLPVLCQAHGLTPDQVVAIASNSGGKQALETVQRLLPVLCQAHGLTPDQVVAIANNNGGKQALETVQRLLPVLCQDHGLSPDQVVAIASHDGGKQALETVQRLLPVLCQDHGLTPDQVVAIASHGGKQALETVQRLLPVLCQDHGLTPDQVVAIASNGGGKQALETVQRLLPVLCQDHGLTPDQVVAIANNNGGKQALATVQRLLPVLCQAHGLTPDQVVAIANNNGGKQALATVQRLLPVLCQAHGLTPDQVVAIASHDGGKQALETVQRLLPVLCQAHGLTPDQVVAIASHDGGKQALETVQRLLPVLCQAHGLTPDQVVAIASNGGGKQALETVQRLLPVLCQAHGLTPDQVVAIASHDGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTEFEARYGTLPPASQRWDRILQASGMKRAKPSPTSAQTPDQASLHAFADSLERDLDAPSPMHEGDQTRASSRKRSRSDRAVTGPSTQQSFEVRVPEQHDALHLPLSWRVKRPRTRIGGGLPDPGTPIAADLAASSTVMWEQDAAPFAGAADDFPAFNEEELAWLMELLPQSGSVGGTI

SEQ ID NO: 140 - protein, 969 aa, Xanthomonas oryzae
MTAVEAVHAWRNALTGAPLNLTPDQVVAIASNIGGNQALETVQRLLPVLCQAHGLTPDQVVAIASNGGKQALETVQRLLPVLCQDHSLTPDQVVAIASNIGGKQALETVQRLLPVLCQDHGLTPDQVVAIASNSGGKQALETVQRLLPVLCQDHGLTPDQVMTIASNNGGKQALETVQRLLPVLCQDHGLTPDQVVTIASNGGGKQALETVQRLLPVLCQDHGLTPAQVVAIANNNGGKQALETVQRLLPVLCQAHGLTPAQVVAIASNSGGKQALETVQRLLPVLCQAHGLTPDQVVAIASNGGKQALETVQRLLPVLCQAHGLTPDQVVAIASNSGGKQALETVQRLLPVLCQAHGLTPDQVVAIANNNGGKQALETVQRLLPVLCQDHGLTPDQVVAIASNSGGKQALETVQRLLPVLCQDHGLTPDQVVAIASNGGKQALETVQRLLPVLCQDHGLTPDQVVAIASNIGGKQALETVQRLLPVLCQDHGLTPDQVVAIASHGGGKQALETVQRLLPVLCQDHGLTSDQVVAIASHDGGKQALETVQRLLPVLCQDHGLTPDQVVAIASNIGGKQALETVQRLLPVLCQDHGLTLDQVVAIASHDGGKQALETVQRLLPVLCQDHGMTPDQVVAIASHDGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTELEARCGTLPPASQRWDRILQASGMKRAKPSPTSAQTPDQASLHAFADSLERDLDAPSPMHEGDQTRASSRKRSRSDRAVTGPSTQQSFEVRVPEQHDALHLPLSWRVKRPRTRIGGGLPDPGTPIAADLAASSTVMWEQDAAPFAGAADDFPAFNEEELAWLMELLPQSGSVGGTI

SEQ ID NO: 141 - protein, 1017 aa, Xanthomonas oryzae
MTAVEAVHAWRNALTGAPLNLTPDQVVAIASNIGGKQALETVQRLLPVLCQDHGLTPDQVVAIASHGGGKQALETVQRLLPVLCQAHGLTPDQVVAIASNIGGKQALETVQRLLPVLCQDHGLTPDQVVAIASHGGGKQALETVQRLLPVLCQDHGLTPDQVVAIASNIGGKQALETVQRLLPVLCQDHGLIPDQVVAIASNIGGKQALETVQRLLPVLCQDHGLTPDQVVAIASNIGGKQALETVQRLLPVLCQAHGLTPDQVVAIASHDGGKQALETVQRLLPVLCQDHGLTPAQVVAIASNNGGKQALETVQRLLPVLCQAHGLTPDQVVAIASHDGGKQALETVQRLLPVLCQDHGLTPAQVVAIASNSGGKQALETVQRLLPVLCQDHGLTPDQVVAIASNGGGKQALETVQRLLPVLCQDHGLTPDQVVAIASSSGGKQALETVQRLLPVLCQDHGLTPDQVVAIASHDGGKQALETVQRLLPVLCQDHGLTPDQVVAIASNIGGKQALETVQRLLPVLCQAHGLTPDQVVAIASNIGGKQALETVQRLLPVLCQDHGLTPDQVVAIANNNGGKQALETVQRLLPVLCQDHGLTPDQVVAIASNIGGKQALETVQRLLPVLCQDHGLTPAQVVAIANNNGGKQALETVQRLLPVLCQDHGLTPDQVVAIASNIGGKQALETVQRLLPVLCQDHGLTPDQVVAIASNGGGKQALESIVAQLSRPDPALAALTNDHLVALACLGGRPALDAVKKGLPHAPELIKRINRRIPERTSHRVADLPERTSHRVADLAHVVRVLGFFQSHSHPAQAFDDAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQHDALHLPLSWRVKRPRTRIGGGLPDPGTPIAADLAASSTVMWEQDAAPFAGAADDFPAFNEEELAWLMELLPQSGSVGGTI

SEQ ID NO: 142 - protein, 904 aa, Xanthomonas oryzae
MTAVEAVHAWRNALTGAPLNLTPDQVVAIASNIGGNQALETVQRLLPVLCQAHGLTPDQVVAIASHGGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIASNIGGKQALETVQRLLPVLCQDHGLTPDQVVAIANNNGGKQALETVQRLLPVLCQDHGLTPDQVVAIASHDGGKQALETVQRLLPVLCQGHGLTPDKVVAIASNSGGKQALETVQRLLPVLCQAHGLTPDKVVAIANNNGGKQALETVQRLLPVLCQDHGLTPDQVVAIASNSGGKQALETVQRLLPVLCQDHGLTPAQVVAIANNNGGKQALETVRRLLPVLCQDHGLTPDQVVAIASHDGGKQALETVQRLLPVLCQDHGLTPDQVVAIANNNGGKQALETVQRLLPVLCQNHGLTPDQVVAIASNIGGKQALETVQRLLPVLCQDHGLTPDQVVAIASHDGGKQALETVQRLLPVLCQDHGLTPAQVVAIANNNGGKQALETVRRLLPVLCQDHGLSPDQVVAIASNSGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADYAQVVRVLEFFQCHSHPAYAFDEAMTQFGMSRNGLLQLFRRVGVTELEARGGTLPPASQRWDRILQASGMKRAKPSPTSAQTPDQASLHAFADSLERDLDAPSPMHEGDQTGASSRKRSRSDRAVTGPSAQHSFEVRVPEQHDALHLPLSWRVKRPRTRIGGGLPDPGTPIAADLAASSTVLWEQDAAPFAGAADDFPAFNEEELAWLMELLPQSGSVGGTI

SEQ ID NO: 143 - protein, 983 aa, Xanthomonas oryzae
MTAVEAVHAWRNALTGAPLNLTPDQVVAIASNIGGNQALETVQRLLPVLCQAHGLTPDQVVAIASHGGGKQALETVQRLLPVLCQDHGLTPDQVVAIASNSGGKQALETVQRLLPVLCQDHGLTPDQVVAIASHGGGKQALETLQRLLPVLCQDHGLTPDQVVAIASHGGGKQALETLQRLLPVLCQAHGLTPAQVVALASHDGGKQALETVQRLLPVLCQDHGLTPDQVVAIASNSGGKQALETVQRLLPVLCQDHGLTPDQVVAIASNGGGKQALETVQRLLPVLCQDHGLTPDHVVAIASHDGGKQALETVQRLLPVLCQDHGLTPDQVVAIANNNGGKQALETVQRLLPVLCQAHGLTPDQVVAIASNGGGKQALETVQRLLPVLCQDHGLTPAQVVAIASHGGGKQALETVQRLLPVLCQAHGLTPDQVVAIASNGGGKQALETVQRLLPVLCQDHGLTPDQVVAIASHDGGKQALETVQRLLPVLCQDHGLTPDQVVAIASHGGGKQALETVQRLLPVLCQDHGLTPDQVVAIASHDGGKQALETVQRLLPVLCQDHGLTPDQVVAIASHDGGKQALETVQRLLPVLCQDHGLTLDQVVAIASNIGGKQALETVQRLLPVLCQDHGLTPAQVVAIANNNGGKQALETVQRLLPVLCQDHGLTPDQVVAIASNGGGKQALESIVAQLSCPDPALAALTNDHLVALACLGGRPALDAVKKGLPHAPELIRRINRRIPERTSHRVADLPERTSNRVADLAQVVRVLGFFQSHSHPAQAFDDAMTQFGMSRHGLVQLFRRVGVTELEARCGTLPPASQRWDRILQASGMKRAKPSPTSAQTPDQASLHAFADSLERDLDAPSPMHEGDQTRASSRKRSRLDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 144 - protein, 1086 aa, Xanthomonas oryzae
MDLRTLGYSQQQQEKIKPKVRSTVAQHHEALVGHGFTHAHIVALSQHPAALGTVAVTYQDIIRALPEATHEDIVGVGKQWSGARALEALLTEAGELRGPPLQLDTGQLLKIAKRGGVTAVKAVHAWRNALTGAPLNLTPAQVVAIASHDGGNQALETVQRLLPVLCQDHGLTPAQVVAIASHDGGKQALETVQRLLPVLCQDHGLTPDQVVAIASHDGGKQALETVQRLLPVLCQDHGLTPAQAVAIASNGGGKQALETVQRLLPVLCQDHGLTPDQVVAIASNGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGKQALETVQRLLPVLCQDHGLTLAQVVAIASNIGGKQALETVQRLLPVLCQDHGLTPDQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPAQVVAIASHIGGKQALETVQRLLPVLCQDHGLTLDQVVAIASNDGSKQALETVQRLLPVLCQDHGLTPDQVVAIASHDGGKQALETVQRLLPVLCQDHGLTPNQVVAIASNIGGKQALETVQRLLPVLCQAHGLTPDQVVAIASHDGGKQALETVQRLLPVLCQNHGLTPDQVVAIASNGGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTELEARCGTLPPASQRWDRILQASGMKRAKPSPTSAQTPDQASLHAFADSLERDLDAPSPMHEGDQTRASNRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 145 - protein, 1483 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEVQSGLRAADDPPPTVRVAVTAARPPRAKPAPRRRAAQPSDASPAAQVDLRTLGYSQQQQEKIKPKVRSTVAQHHEALVGHGFTHAHIVALSQHPAALGTVAVTYQDIITALPEATHEDIVGVGKQWSGARALEALLTKAGELRGPPLQLDTGQLLKIAKRGGVTAVEAVHASRNALTGAPLNLTPDQVVAIASHDGGKQALETVQRLLPVLCQAHGLTPAQVVAIASHDGGKQALETVQRLLPVLCQAHGLTPAQVVAIASNNGGKQALETVQRLLPVLCQAHGLTPDQVVAIASNNGGKQALETVQRLLPVLCQAHGLTPDQVVAIASNGGGKQALETVQRLLPVLCQAHGLTPDQVVAIASNGGGKQALETVQRLLPVLCQAHGLPPAQVVAIASHDGGKQALETVQRLLPVLCEAHGLTPAQVVAIASNSGGKQALETVQRLLPVLCQAHGLTLDQVVAIASHGGSKQALETVQRLLPVLCQDHGLTPDQVVAIASHDGGKQALETVQRLLPVLCQAHGLTPAQAVAIASNGGGKQALETVQRLLPVLCQDHGLTPDQVVAIASNGGKQALETVQRLLPVLCQDHGLTPDQVVAIASHDGGKQALATVQRLLPVLCQDHGLTPDQVVAIASHDGGKQALETVQRLLPVLCQDHGLTPDQVVAIASHDGGKQALETVQRLLPVLCQDHGLTPDQVVAIASNGGKQALETVQRLLPVLCQDHGLTPDQVVAIANNNGGKQALETVQRLLPVLCQDHGLTPDQVVAIASNQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPAQVVAIASHIGGKQALETVQRLLPVLCQDHGLTLDQVVAIASNDGSKQALETVQRLLPVLCQDHGLTPDQVVAIASHDGGKQALETVQRLLPVLCQDHGLTPDQVVAIASHGGGKQALETVQRLLPVLCQDHGLTSAQVVAIANNNGGKQALETVQRLLPVLCQDHGLTPDQVVAIASHGGGKQALETVQRLLPVLCQDHGLTPDQVVAIASNGGKQALESIVAQLSRPDPALAALTNDHLVALACLGGRPALDAVKKGLPHAPELIRRINRRIPERTSHHVPDLAHVVRVLGFFQSHSHPAQAFDDAMTQFGMSRNGLVQLFRRVGVTELEARGGTLPPASQRWDRILQASGMKRAKPSPTSAQTPDQASLHAFADSLERDLDAPSPMHEGDQTGASSRKRSRSDRAVTGPSAQQSFEVRVPEQRDALHLPLSWRVKRPRTRIGGGLPDPGTPIAADLAASSTVLWEQDAAPFAGAADDFPAFNEEELAWLMELLPQSGSVGGTI

SEQ ID NO: 146 - protein, 868 aa, Xanthomonas oryzae
MTAVEAVHASRNALTGAPLNLTPDQVVAIASNIGGNQALETVQRLLPVLCQDHGLTPDQVVAIANNNGGKQALETVQRLLPVLCQAHGLTPDQVVAIASNGGKQALETVQRLLPVLCQAHGLTPNQVVAIASNGGGKQALETVQRLLPVLCQAHGLTQDQVVAIASNSGGKQALETVQRLLPVLCQAHGLTPAQVVAIASNNGGKQALETVQRLFPVLCQDHGLTPDQVVTIANNNGGKQALETVQRLLPVLCQAHGLIPDQVVAIANNNGGKQALETVQRLLPVLCQAHGLTPAQVVAIASNIGGKQALETVQRLLPVLCRAHGLTPAQVVAIANNNGGKQALETVQRLLPVLCQAHGLTPDQVVAIASNIGGKQALETVQRLLPVLCQDHGLTPDQVVAIASNGGKQALETVQRLLPVLCQDHGLTPAQVVAIASHDGGKQALETVQRLLPVLCQDHGLTLDQVVAIASHDGGKQALETVQRLLPVLCQDHGLTLDQVVAIASNIGGKQALETVQRLLPVLCQDHGLTPDQVVAIASNGGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADLAHVVRVLGFFQSHSHPAQAFDDAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSTQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 147 - protein, 734 aa, Xanthomonas oryzae
MTAVEAVHAWRNALTGAPLNLTPDQVVAIASNIGGKQALETVQRLLPVLCQDHGLTPDQVVAIASNNGGKQALETVQRLLPVLCQAHGLTPDQVVAIASNIGGKQALETVQRLLPVLCQDHGLTPDQVVAIASHGGGKQALETVQRLLPVLCQDHGLTPDQVVAIASHGGGKQALETVQRLLPVLCQDHGLTPDQVVAIANNVGGKQALATVQRLLPVLCQDHGLTPDQVVAIASHGGGKQALETVQRLLPVLCQDHGLTPDQVVAIASHDGGKQALETVQRLLPVLCQDHGLTPDQVVAIASHGGGKQALETVQRLLPVLCQDHGLTPDQVVAIASHDGGKQALETVQRLLPVLCQDHGLTLDQVVAIASHDGGKKALETVQRLLPVLCQDHGLTPDQVVAIASHDGGKQALETVQRLLPVLCQDHGLTPDQVVAIASNGGGKQALESIVAQLSRPDPALAALTNDHLVALACLGGRPALDAVKKGLPHAPELIRRVNSRIGERTSHRVADYAQVVRVLEFFQCHSHPAYAFDEAMTQFGMSRHGLVQLFRRVGVTEFEARCGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 148 - protein, 1107 aa, Xanthomonas oryzae
MTAVEAVHASRNALTGAPLNLTPAQVVAIASNNGGKQALETVQRLLPVLCQAHGLTPAQVVAIASHDGGKQALETVQRLLPVLCQDHGLTPDQVVAIASNSGGKQALETVQRLLPVLCQDHGLTPDQVVAIASNGGGKQALETVQRLLPVLCQDHGLTPDQVVAIASHDGGKQALETVQRLLPVLCQDHGLTPDQLVAIANNNGGKQALETVQRLLPVLCQDHGLTPDQVVAIASNGGKQALETVQRLLPVLCQDHGLTPDQVVAIASNIGGKQALETVQRLLPVLCQAHGLTPAQVVAIASHDGGKQALETMQRLLPVLCRAHGLTPAQVVAIASNSGGKQALETVQRLLPVLCQAHGLTPAQVVAIVSHDGGKQALETVQRLLPVLCQAHGLTPDQVVAIASNNGGKQALETVQRLLPVLCQDHGLTPDQVVAIASHDGGKQALGTVQRLLPVLCQDHGLTPDQVVAIASNNGGKQALETVQRLLPVLCQDHGLTPDQVVAIASHDGGKQALETVQRLLPVLCQAHGLTPAQVVAIASNNGGKQALETVQRLLPVLCQDHGLTPDQVVAIANNNGGKQALETVQRLLPVLCQAHGLTPAQVVAIASNNGSKQALETVQRLLPVLCQAHGLTPAQVVAIASNNGGKQALETVQRLLPVLCQAHGLTPDQVVAIASNNGGKQALETVQRLLPVLCQAHGLTPDQVVAIASNNGGKQALETVQRLLPVLCQAHGLTPDQVVAIASNNGGKQALETVQRLLPVLCQDHGLTPAQVVAIASHDGGKQALETVQRLLPVLCQDHGLTPAQVVAIASNGGGKQALESIVAQLSRPDPALAALTNDHLVALACLGGRPALDAVKKGLPHAPELIRRVNSRIGERTSHRVADYAQVVRVLEFFQCHSHPAYAFDEAMTQFGMSRNGLLQLFRRVGVTELEARGGTLPPASQRWDRILQASGMKRAKPSCASAQTPDQASLHAFADSLERDLDAPSPMHEGDQTRASSRKRSRSDRAVTGPSAQQSFEVRVPEQRDALHLPLSWRVKRPRTRIGGGLPDPGTPMAADLAASSTVMWEQDAAPFAGAADDFPAFNEEELAWLMELLPQSGSVGGTI

SEQ ID NO: 149 - protein, 1266 aa, Xanthomonas axonopodis
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIARNIGGKQALETVQRLLPVLCQAHGLTPEQVVAIASNSGGKQALETVQRLLPVLCQAHGLTPEQVVAIASHDGGKQALETVQRLLPVLCQAHGLTPAQVVAIASNGGGKQALETVQRLLPVLCQAHGLTPEQVVAIASHDGGKQALETVQRLLPVLCQAHGLTPAQVVAIASNGGGKQALETVQRLLPVLCQAHGLTPAQVVAIASNGGGKQALETVQRLLPVLCQAHGLTPAQVVAIASHDGGKQALETVQRLLPVLCQAHGLTPEQVVAIASNIGGKQALETVQRLLPVLCQAHGLTPQQVVAIASNGGGRPALETVQRLLPVLCQAHGLTPEQVVAIASNIGGKQALETVQRLLPVLCQAHGLTPQQVVAIASNGGGRPALETVQRLLPVLCQAHGLTPEQVVAIASNIGGKQALETVQRLLPVLCQAHGLTPQQVVAIASNGGGRPALETVQRLLPVLCQAHGLTPEQVVAIASNIGGKQALETVQRLLPVLCQAHGLTPQQVVAIASHDGGKQALETVQRLLPVLCQAHGLTPEQVVAIASNIGGKQALETVQRLLPVLCQAHGLTPQQVVAIASHDGGKQALETVQRLLPVLCQAHGLTPEQVVAIASNIGGKQALETVQRLLPVLCQAHGLTPQQVVAIASNGGGRPALETVQRLLPVLCQAHGLTPAQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 150 - protein, 514 aa, Ralstonia solanacearum
  MOD_RES (1)..(3): Any amino acid
  MOD_RES (503)..(514): Any amino acid
XXXAKYHATLAGQGFTHADICRISRRWQSLRVVANNYPELMAALPRLTTAQIVDIARQRSGDLALQALLPVAAALTAAPLGLSASQIATVAQYGERPAIQALYRLRRKLTRAPLGLTPQQVVAIASNTGGKQALEAVTVQLRVLRGARYGLSTEQVVAVASNKGGKQALAAVEAQLLRLRAAPYELSTEQVVAVASHNGGKQALEAVRAQLLDLRAAPYELSTEQVVAIASHNGGKQALEAVRAQLPALRAAPYGLSTEQVVAIASHNGGKQALEAVRAQLPALRAAPYGLSTEQVVAIASNNGGKQALEAVKAQLPVLRRAPYGLSTEQVVAIASNGGGKQALEGIGKQLQELRAAPHGLSTAQVATIASSIGGRQALEAVKVQLPVLRAAPYGLTIAQVVAVASHNGGKQALEAIGAQLLALRAAPYALSTAQVVAIASNDGGKQALEEVDLPVLALRAAPYELSSAQVIAIAAGNDGGGKQALEAVKAQLPVLRAAPYEXXXXXXXXXXXX

SEQ ID NO: 151 - protein, 1164 aa, Ralstonia solanacearum
MRRRTAVGRVPGASRSGTSPLVLSQPLSRVSASPQPARSSAISSPNFSAGNPTAFANPSPSLPPTPVLPPTPVLYAMARELEELHNATWQPAVPLTAEPLADARRDNTVVDGGSGSSPAIASARPQAFAGPPRAPRSARARRARTAGDAWPAPAYLGPSPSPSPSPSPSPRIAPDLSGKLAALGYSREQIRKLKQESLAEVAKYHATLAGQGFTHADICRISRRWQSLRVVANNYPELMAALPRLTTAQIVDIARQRSGDLALQALLPVAAALTAAPLGLSASQIATVAQYGERPAIQALYRLRRKLTRAPLGLTPQQVVAIASNTGGKQALEAVTVQLRVLRGARYGLSTEQVVAVASNKGGKQALAAVEAQLLRLRAAPYELSTEQVVAVASHNGGKQALEAVRAQLLDLRAAPYELSTEQVVAIASHNGGKQALEAVRAQLPALRAAPYGLSTEQVVAIASHNGGKQALEAVKAQLPVLRRAPYGLSTEQVVAIASNGGGKQALEGIGKQLQELRAAPHGLSTAQVATIASSIGGRQALEAVKVQLPVLRAAPYGLTIAQVVAVASHNGGKQALEAIGAQLLALRAAPYALSTAQVVAIASNDGGKQALEEVEAQLLALRAAPYELSSAQVIAIAAGNDGGGKQALEAVKAQLPVLRAAPYELSVAQVVTIASHNGGKQALEAVRAQLLALRAAPYGLSTAQVVAVAGRNGGKQALEAVRAQLPALRAAPYGLSIAQVVAVASRSGGKQALEAVRAQLLALRAAPYGLSTAQVVAVASGSGGKPALEAVRAQLLALRAAPYGLSTAQVVAVASHDGGKPALEAVRKQLPVLRGVPHQLSIAQVIAIACIGGRQALTAIEMHMLALRAAPYNLSPERVVAIVCIGGRSAVEAIRHGLPVKRIQRIRRRKAPEATPPAGPFGPTPQELVAVLHFFRAHRQPRHAFVDALTEFQITRAALLRLLSSAGVTEIEALGGTIPDAAERWQRLLGRLGTRQAIGVAAPSPDSLQGFAQSLERSMLSPGIAEQSASPPPRERPAETAIAPRSNTGRPSEPWLDQPAWSQHRKRTVRSRMRADAVANMPANPHRDARAQFTPGCLPPAPGPMPAHISPASAGSSSHVASGSVLPDPGTPTGSDLAMLEAESFGAAALAFDFDSFLQMLDV

SEQ ID NO: 152 - protein, 1238 aa, Xanthomonas oryzae
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAEWDEAQSGLRAADDPPPTVRVAVTAARPPRAKPAPRRRAAQPSDASPAAQVDLRTLGYSQQQQEKIKPKVRSTVARHHEALVGHGFTHAHIVALSQHPAALGTVAVTYQDIIRALPEATHEDIVGVGKQWSGARALEALLTEAGELRGPPLQLDTGQLLKIAKRGGVTAVKAVHAWRNALTGAPLNLTPAQVVAIASHDGGNQALETVQRLLPVLCQDHGLTPAQVVAIASHDGGKQALETVQRLLPVLCQDHGLTPDQVVAIASHDGGKQALETVQRLLPVLCQDHGLTPAQAVAIASNGGGKQALETVQRLLPVLCQDHGLTPDQVVAIASNGGKQALETVQRLLPVLCQDHGLTPDQVVAIASNNGGKQALETVQRLLPVLCQDHGLTPDQVVAIASHDGGKQALETVQRLLPVLCQDHGLTPDQVVAIASHDGGKQALETVQRLLPVLCQDHGLTPDQVVAIASNGGKQALETVQRLLPVLCQDHGLTLAQVVAIASNIGGKQALETVQRLLPVLCQDHGLTPDQVVAIASNNGGKQALETVQRLLPVLCQDHGLTPDQVVAIASHDGGKQALETVQRLLPVLCQDHGLTPAQVVAIASHIGGKQALETVQRLLPVLCQDHGLTLDQVVAIASNDGSKQALETVQRLLPVLCQDHGLTPDQVVAIASHDGGKQALETVQRLLPVLCQDHGLTPNQVVAIASNIGGKQALETVQRLLPVLCQAHGLTPDQVVAIASHDGGKQALETVQRLLPVLCQNHGLTPDQVVAIASHDGGKQALETVQRLLPVLCQNHGLTPDQVVAIASNGGGKQALETVQRLLPVLCQDHGLTPDQVVAIASNGGGKQALESIVAQLSRPDPALAALTNDHLVALACLGGRPALDAVKKGLPHAPELIRRINRRIPERTSHRVADYAQVVRVLEFFQCHSHPAYAFDEAMTQFGMSRNGLVQLFRRVGVTELEARCGTLPPASQRWDRILQASGMKRAKPSPTSAQTPDQASLHAFADSLERDLDAPSPMHEGDQTRASSRKRSRSDRAVTGPSAQQSFEVRVPEQRDALHLPLSWRVKRQRTRIGGGLPDPGTPIAADLAASSTVMWEQDAAPFAGAADDFPAFNEEELAWLMELLPQSGSVGGTI

SEQ ID NO: 153 - protein, 795 aa, Xanthomonas citri
AWRNALTGAPLNLTPEQVVAIASNIGGKQALETVQRLLPVLCQAHGLTPDQVVAIASNGGKQALETVQRLLPVLCQAHGLTPAQVVAIASNIGGKQALETVQRLLPVLCQAHGLTPDQVVAIASNIGGKQALETVQRLLPVLCQAHGLTPEQVVAIASHDGGKQALETVQRLLPVLCQAHGLTPEQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNGGKQALETVQRLLPVLCQAHGLTPAQVVAIASHDGGKQALETVQRLLPVLCQAHGLTPEQVVAIASNSGGKQALETVQRLLPVLCQAHGLTPAQVVAIASNIGGKQALETVQRLLPVLCQAHGLTPEQVVAIASHDGGKQALETVQRLLPVLCQAHGLTPAQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNSGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHA

SEQ ID NO: 154 - protein, 1266 aa, Xanthomonas axonopodis
MDPIRSRTPSPARELLPGPQPDRVQPTADRGVSPPAGGPLDGLPARRTMSRTRLPSPPAPSPAFSAGSFSDLLRQSDPSLLDTSIFDSMPAVGTPHTEAATGEWDEVQSGLRAADAPPPTMRVAVTAARSPRANPAPRRRAAQPSDASPAAQVDLRTLGYSQQQQEKIKPKVRSTVAQHHEALVGHGFTHAHIVALGQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIARNIGGKQALETVQRLLPVLCQAHGLTPEQVVAIASNSGGKQALETVQRLLPVLCQAHGLTPEQVVAIASHDGGKQALETVQRLLPVLCQAHGLTPAQVVAIASNGGGKQALETVQRLLPVLCQAHGLTPEQVVAIASHDGGKQALETVQRLLPVLCQAHGLTPAQVVAIASNGGGKQALETVQRLLPVLCQAHGLTPAQVVAIASNGGGKQALETVQRLLPVLCQAHGLTPAQVVAIASHDGGKQALETVQRLLPVLCQAHGLTPEQVVAIASNIGGKQALETVQRLLPVLCQAHGLTPQQVVAIASNGGGRPALETVQRLLPVLCQAHGLTPEQVVAIASNIGGKQALETVQRLLPVLCQAHGLTPQQVVAIASNGGGRPALETVQRLLPVLCQAHGLTPEQVVAIASNIGGKQALETVQRLLPVLCQAHGLTPQQVVAIASNGGGRPALETVQRLLPVLCQAHGLTPEQVVAIASNIGGKQALETVQRLLPVLCQAHGLTPQQVVAIASHDGGKQALETVQRLLPVLCQAHGLTPEQVVAIASNIGGKQALETVQRLLPVLCQAHGLTPQQVVAIASHDGGKQALETVQRLLPVLCQAHGLTPEQVVAIASNIGGKQALETVQRLLPVLCQAHGLTPQQVVAIASNGGGRPALETVQRLLPVLCQAHGLTPAQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 155 - protein, 1163 aa, Xanthomonas axonopodis
MDPIRSRTPSPARELLPGPQPDGVQPTADRGVSPPAGGPLDGLPARRTISRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGASLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLCQAHGLTPEQVVAIASHDGGKQALETVQRLLPVLCQAHGLTPDQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIACNGGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 156 - protein, 1163 aa, Xanthomonas axonopodis
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLCQAHGLTPEQVVAIASHDGGKQALETVQRLLPVLCQAHGLTPDQVVAIASHDGGKQALETVQRLLPVLCQAHGLTPQQVVAIASNGGGKQALETVQRLLPVLCQAHGLTPEQVVAIASHDGGRQALETVQRLLPVLCQAHGLTPEQVVAIASNGGGKQALETVQRLLPVLCQAHGLTPEQVVAIASNGGGKQALETVQRLLPVLCQAHGLTPEQVVAIASNGGGKQALETVQRLLPVLCQAHGLTLDQVVAIASNGGGKQALETVQRLLPVLCQAHGLTPEQVVAIASNSGGKQALETVQRLLPVLCQAHGLTPDQVVAIASHDGGKQALETVQRLLPVLCQAHGLTPEQVVAIASHDGGKQALETVQRLLPVLCQAHGLTPEQVVAIACNGGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPTHEGDQRRASSRKRSRSDRAVTGPSAQQSFEVRVPEQRDALHLPLSWRVKRPRTSIGGGLPDPGTPTAADLAASSTVMREQDEDPFAGAADDFPAFNEEELAWLMELLPQ

SEQ ID NO: 157 - protein, 711 aa, Xanthomonas fuscans
MGHGFTRAHIVALSQHPAALGTVAVKYQAMIAALPEATHEDIVGVGKQWSGARALEALLTVSGELRGPPLQLDTGQLLKIAKRGGVTAVEAVHAWRNALTGAPLNLTPDQVVAIASHDGGKQALETVQRLLPVLCEQHGLTPAQVVAIASNGGGKQALETVQQLLPVLCEQHGLTPDQVVAIASHDGGKQALETVQRLLPVLCEQHGLTPAQVVAIASNGGGKQALETVQQLLPVLCEQHGLTPDQVVAIASNIGGKQALETVQRLLPVLCEQHGLTPAQVVAIASNGGGKQALKTVQQLLPVLCEQHGLTPDQVVAIASHDGGKQALETVQRLLPVLCEQHGLTPDQVVAIASNGGGKQALETVQRLLPVLCEQHGLTPDQVVAIASNGGGKQALETVQRLLPVLRQAHGLTPAQVVAIASNGGGRPALESIFAQLSRPDQALAALTNDHLVALACLGGRPALEAVKKGLPHAPTLIKRTNRRLPERTSHRVADHAQVARVLGFFQCHSHPAQAFDEAMTQFGMSRHGLLQLFRRVGVTELEARGGTLPPAPQRWHRILQASGMKRAEPSGASAQTPDQASLHAFADALERELDAPSPIDQAGQALASSSRKRSRSESSVTGSFAQQAVEVRVPEQRDALHLPPLSWGVKRPRTRIGGGLPDPGTPMDADLAASSTVMWEQDADPFAGAADDFPAFNEEEMAWLMELFPQ

SEQ ID NO: 158 - protein, 847 aa, Xanthomonas fuscans
MGHGFTHAHIVALSQHPAALGTVAVKYQAMIAALPEATHEDIVGVGKQWSGARALEALLTVSGELRGPPLQLDTGQLLKIAKRGGVTAVEAVHAWRNALTGAPLNLTPDQVVAIASNGGGKQALETVQRLLPVLCEQHGLTPDQVVAIASNGGGKQALETVQRLLPVLCEQHGLTPDQVVAIASNGGGKQALETVQRLLPVLCEQHGLTPDQVVAIASNGGGKQALETVQRLLPVLCEQHGLTPDQVVAIASNGGGKQALETVQRLLPVLCEQHGLTPDQVVAIASNGGGKQALETVQRLLPVLCEQHGLTPAQVVAIASNIGGKQALETVQRLLPVLCEQHGLTPDQVVAIASHDGGKQALETVQRLLPVLCEQHGLTPDQVVAIASNGGGKQALETVQRLLPVLCEQHGLTPDQVVAIASNGGGKQALETVQRLLPVLCKQHGLTPDQVVAIASNNGGKQALETVQRLLPVLCEQHGLTPAQVVAIASNNGGKQALETVQRLLPVLCEQHGLTPAQVVTIASNNGGKQALETVQRLLPVLCEQHGLTPAQVVAIASNGGGRPALESIFAQLSRPDQALAALTNDHLVALACLGGRPALEAVKKGLPHAPTLIKRTNRRLPERTSHRVADHAQVARVLGFFQCHSHPAQAFDEAMTQFGMSRHGLLQLFRRAGVTELEAHSGTLPPASQRWHRILQASGMKRAEPSGASAQTPDQASLHAFADALERELDAPSPIDRAGQALASSSRKRSRSESSVTSSFAQQAVEVRVPEQRDALHFLPLSWGVKRPRTRIGGGLPDPGTPMDADLAPSSTVMWEQDADPFAGAADDFPAFNEEEMAWLMELFPQ

SEQ ID NO: 159 - protein, 715 aa, Xanthomonas fuscans
MLCEQHGLTPDQVVAIASNIGGKQALETVQRLLPVLCEQHGLTPDQVVAIASNGGGKQALETVQRLLPVLCEQHGLTPDQVVAIASNIGGKQALETVQRLLPVLCEQHGLTPDQVVAIASNIGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASHDGGKQALETVQRLLPVLRQAHGLTPAQVVAIASHDGGKQALETVQRLLPVLCEQHGLTPDQVVAIASNGGGRPALETVQRLLPVLCEQHGLTPDQVVAIASNGGGKQALETVQRLLPVLCEQHGLTPAQVVAIASNGGGRPALESIFAQLSRPDQALAALTNDHLVALACLGGRPALEAVKKGLPHAPTLIKRTNRRLPERTSHRVADHAQVARVLGFFQCHSHPAQAFDEAMTQFGMSRHGLLQLFRRAGVTELEAHSGTLPPASQRWHRILQASGMKRAEPSGASAQTPDQASLHAFADALERELDAPSPIDRAGQALASSSRKRSRSESSVTGSFAQQAVEVRVPEQRDALHFLPLSWGVKRPRTRIGGGLPDPGTPMDADLAPSSTVMWEQDADPFAGAADDFPAFNEEEMAWLMELFPQ

SEQ ID NO: 160 - protein, 1078 aa, Xanthomonas fuscans
MSAFGAPHTEAAPGEADEVQSGLRAVDDPHPTVHVAVTAARPPRAKPAPRRRAAHTSDASPAGQVDLCTLGYSQQQQDEIKPKARATVAQHHQALMGHGFTRAHIVALSQHPAALGTVAVKYQAMIAALPEATHEDIVGVGKQWSGARALEALLTVSGELRGPPLQLDTGQLLKIAKRGGVTAVEAVHAWRNALTGAPLNLTPDQVVAIASHDGGKQALETVQRLLPVLCEQHGLTPDQVVAIASNGGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASNIGGKQALETVQRLLPVLCEQHGLTPDQVVAIASNGGGKQALETVQRLLPVLCEQHGLTPDQVVAIASNIGGKQALETVQRLLPVLCEQHGLTPAQVVAIASNGGGKQALETVQQLLPVLCEQHGLTPDQVVAIASNIGGKQALETVQRLLPVLCEQHGLTPDQVVAIASNIGGKQALETVQRLLPVLCEQHGLTPDQVVAIASHDGGKQALETVQRLLPVLCEQHGLTPDQVVAIASNGGGKQALETVQRLLPVLCEQHGLTPDQVVAIASHDGGKQALETVQRLLPVLCEQHGLTPDQVVAIASHDGGKQALETVQRLLPVLRQAHGLTPAQVVAIASHDGGKQALETVQRLLPVLCEQHGLTPDQVVAIASNGGGKQALETVQRLLPVLCEQHGLTPDQVVAIASNGGGKQALETVQRLLPVLRQAHGLTPAQVVAIASNGGGRPALESIFAQLSRPDQALAALTNDHLVALACLGGRPALEAVKKGLPHAPTLIKRTNRRLPERTSHRVADHAQVARVLGFFQCHSHPAQAFDEAMTQFGMSRHGLLQLFRRVGVTELEARGGTLPPAPQRWHRILQASGMKRAEPSGASAQTPDQASLHAFADALERELDAPSPIDQAGQALASSSRKRSRSESSVTGSFAQQAVEVRVPEQRDALHLPPLSWGVKRPRTRIGGGLPDPGTPMDADLAASSTVMWEQDADPFAGAADDFPAFNEEEMAWLMELFPQ

SEQ ID NO: 161 - protein, 879 aa, Xanthomonas fuscans
MDPIRPRTSSPAHELLAGPQPDRVQPQPTADRGGAPPAGSPLDGLPARRTMSRTRLPSPPAPLPAFSAGSFSDLLCQFDPLLLDTLLFDSMSAFGAPHTEAAPGEADEVQSGLRAVDDPHPTVHVAVTAARPPRAKPAPRRRAAHTSDASPAGQVDLCTLGYSQQQQDEIKPKARATVAQHHQALMGHGFTRAHIVALSQHPAALGTVAVKYQAMIAALPEATHEDIVGVGKQWSGARALEALLTVSGELRGPPLQLDTGQLLKIAKRGGVTAVEAVHAWRNALTGAPLNLTPDQVVAIASNIGGKQALETVQRLLPVLCEQHGLTPDQVVAIASNGGGKQALETVQRLLPVLCEQHGLTPDQVVAIASNIGGKQALETVQRLLPVLCEQHGLTPDQVVAIASNGGGKQALETVQRLLPVLCEQHGLTPDQVVAIASNIGGKQALETVQRLLPVLCEQHGLTPDQVVAIASNIGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASNIGGKQALETVQRLLPVLCEQHGLTPDQVVAIASHDGGKQALETVQRLLPVLCEQHGLTPDQVVAIASNGGGKQALETVQRLLPVLCEQHGLTPDQVVAIASNGGGRPALETVQRLLPVLCEQHGLTPDQVVAIASNGGGKQALETVQRLLPVLCEQHGLTPAQVVAIASNGGGRPALESIFAQLSRPDQALAALTNDHLVALACLGGRPALEAVKKGLPHAPTLIKRTNRRLPERTSHRVADHAQVARVLGFFQCHSHPAQAFDEAMTQSG

SEQ ID NO: 162 - protein, 139 aa, Xanthomonas fuscans
  MOD_RES (114)..(115): Any amino acid
MAIASNIGGKQALETVQRLLPLLCEQHGLTPDQVVAIASNVGGKQALETVQRLLPVLCEQHGLTPDQVVAIASNIGGKQALETVQRLLPVLCEQHGLTPAQVVAIASNGGGKQXXPSIELLTLSASRSGGDTDLLLIFY

SEQ ID NO: 163 - protein, 1168 aa, Xanthomonas axonopodis
MDPIRPRTSSPAHELLAGPQPDRVQPQPTADRGGAPPAGSPLDGLPARRTMSRTRLPSPPAPLPAFSAGSFSDLLCQFDPLLLDTLLFDSMSAFGAPHTEAAPGEADEVQSGLRAVDDPHPTVHVAVTAARPPRAKPAPRRRAAHTSDASPAGQVDLCTLGYSQQQQDEIKPKARATVAQHHQALMGHGFTRAHIVALSQHPAALGTVAVKYQAMIAALPEATHEDIVGVGKQWSGARALEALLTVSGELRGPPLQLDTGQLLKIAKRGGVTAVEAVHAWRNALTGAPLNLTPDQVVAIASHDGGKQALETVQRLLPVLCEQHGLTPDQVVAIASNGGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASNIGGKQALETVQRLLPVLCEQHGLTPDQVVAIASNGGGKQALETVQRLLPVLCEQHGLTPDQVVAIASNIGGKQALERVQRLLPVLCEQHGLTPAQVVAIASNGGGKQALETVQQLLPVLCEQHGLTPDQVVAIASNIGGKQALETVQRLLPVLCEQHGLTPDQVVAIASNIGGKQALETVQRLLPVLCEQHGLTPDQVVAIASHDGGKQALETVQRLLPVLCEQHGLTPDQVVAIASNGGGKQALETVQRLLPVLCEQHGLTPDQVVAIASHDGGKQALETVQRLLPVLCEQHGLTPDQVVAIASHDGGKQALETVQRLLPVLRQAHGLTPAQVVAIASHDGGKQALETVQRLLPVLCEQHGLTPDQVVAIASNGGGKQALETVQRLLPVLCEQHGLTPDQVVAIASNGGGKQALETVQRLLPVLRQAHGLTPAQVVAIASNGGGRPALESIFAQLSRPDQALAALTNDHLVALACLGGRPALEAVKKGLPHAPTLIKRTNRRLPERTSHRVADHAQVARVLGFFQCHSHPAQAFDEAMTQFGMSRHGLLQLFRRVGVTELEARGGTLPPAPQRWHRILRASGMKRAEPSGASAQTPDQASLHAFADALERELDAPSPIDQAGQALASSSRKRSRSESSVTGSFAQQAVEVRVPEQRDALHLPPLSWGVKRPRTRIGGGLPDPGTPMDADLAASSTVMWEQDADPFAGAADDFPAFNEEEMAWLMELLPQ

SEQ ID NO: 164 - protein, 1066 aa, Xanthomonas axonopodis
MDPIRPRTSSPAHELLAGPQPDRVQPQPTADRGGAPPAGSPLDGLPARRTMSRTRLPSPPAPLPAFSAGSFGDLLCQFDPLLLDTLLFDSMSAFGAPHTEAAPGEADEVQSGLRAVDDPHPTVHVAVTAARPPRAKPAPRRRAAHTSDASPAGQVDLCTLGYSQQQQDEIKPKARATVAQHHQALMGHGFTRAHIVALSQHPAALGTVAVKYQAMIAALPEATHEDIVGVGKQWSGARALEALLTVSGELRGPPLQLDTGQLLKIAKRGGVTAVEAVHAWRNALTGAPLNLTPDQVVAIASNIGGKQALETVQRLLPVLCEQHGLTPDQVVAIASNIGGKQALETVQRLLPVLCEQHGLTPDQVVAIASNIGGKQALETVQRLLPVLCEQHGLTPDQVVAIASNGGGKQALETVQRLLPVLCEQHGLTPDQVVAIASNIGGKQALETVQRLLPVLCEQHGLTPDQVVAIASNIGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASHDGGKQALETVQRLLPVLCEQHGLTPDQVVAIASNIGGKQALETVQRLLPVLCEQHGLTPDQVVAIASHDGGKQALETVQRLLPVLCEQHGLTPDQVVAIASNGGGKQALETVQRLLPVLCEQHGLTPDQVVAIASNGGGRPALETVQRLLPVLCEQHGLTPDQVVAIASNGGGKQALETVQRLLPVLCEQHGLTPAQVVAIASNGGGRPALESIFAQLSRPDQALAALTNDHLVALACLGGRPALEAVKKGLPHAPTLIKRTNRRLPERTSHRVADHAQVARVLGFFQCHSHPAQAFDEAMTQFGMSRHGLLQLFRRAGVTELEAHSGTLPPASQRWHRILQASGMKRAEPSGASAQTPDQASLHAFADALERELDAPSPIDRAGQALASSSRKRSRSESSVTGSFAQQAVEVRVPEQRDALHFLPLSWGVKRPRTRIGGGLPDPGTPMDADLAPSSTVMWEQDADPFAGAADDFPAFNEEEMAWLMELLPQ

SEQ ID NO: 165 - protein, 906 aa, Ralstonia solanacearum
MAALGYSREQIRKLKQESLSGVAKYHAPLTRHGFTHTDICRISRRWQSLRMVAKNYPKLIAALPDLTRTHIVDIARQRSGDLALEALLPVATALAAAPLRLRASQIAIIAQCGERPAILALHRLRRKLTGAPLNLTPQQVVAIAANTGGKQALGAITTQLPILRAAPYELSPEQVVAIASNNGGKPALEAVKAQLLELRAAPYELSPEQVVAIASNNGGKPALEAVKALLLALRAAPYELSTEQVVAIASNNGGKPALEAVKALLLELRAAPYELSTGQVVAIASNGGGRQALEAVREQLLALRAVPYELSTEQVVVIANSIGGKQALEAVKVQLPVLRAAPYELNTEQVVAVASNKGGKQALEAVGAQLLALRAVPYALTTAQVVAIASNDGGKQALEAVGAQLLVLRAVPYELTTAQVVAIASNDGGKQTLEVAGAQLLALRAVPYELSTEQVVAIASNNGGKQALEAVKTQLLALRTAPYELSTEQVVAIASNNGGKQALEAVKAQLPALRAAPYELSTEQVVAIASNNGGKQALEAVKAQLLVLRAAPYGLSTAQVVAIAANNGGKQALEAVRALLPVLRVAPYELSTTRVVSIACIGGRQALEAIKTHMPALRQAPYSLSHERVVAIVCIGGRSALEAARHGLPVRDIRRIRNRKTSDATLPAPVLGPTPQELVAVLHFFRTHQQPRQAFVDALTAFQTTRRALLRLLSSAGVTEIEALGGMIPDAAERWQRLLGRLGIRPATDTVVTSPDPMQGFAQSLERSLMSSGTTEQSASPSQHRWPAGTAKTPESARHRLDNAAQPPMQWPDQLVWSQRRRCTASSQTPPPGAASVPANLQWGARAQRTSSRLQPELRPMPARVVPASAQPSPLGDLEFGLPDPGTPTAADLALDLDWLLQLLDL

SEQ ID NO: 166 - protein, 51 aa, Xanthomonas citri
EQVVAIASNIGGKQALETVQRLLPVLCQAHGLTPEQVVAIASHDGGKQALE

SEQ ID NO: 167 - protein, 1032 aa, Xanthomonas axonopodis
MDPIRPRTPSPAHELLAGPQPDRVQPQPTADRGGAPPAGSPLDGLPARRTMSRTRLPSPPAPLPAFSAGSFSDLLRQFDPSLLDTSLFNSMSAFGAPHTEAASGEGDEVQSGLRAADDPQATVQVAVTAARPPRAKPAPRRRAAHTSDASPAGQVDLCTLGYSQQQQEKIKLKARSTVAQHHEALIGHGFTRAHIVALSQHPAALGTVAVKYQAMIAALPEATHEDIVGGGKQWSGARALEALLTVSGELRGPPLQLDTGQLLKIAKRGGVTAVEAVHAWRNALTGAPLNLTPDQVVAIASNIGGKQALETVQRLLPVLCEQHGLTLDQVVAIASNGGGKQALETVQRLLPVLCEQHGLTPDQVVAIASNIGGKQALETVQRLLPVLCEQHGLTPDQVVAIASNNGGKQALETVQRLLPVLCEQHGLTPDQVVAIASNIGGKQALETVQRLLPVLRQAHGLTPAQVVAIASHDGGKQALETVQQLLPVLCEQHGLTPAQVVAIASNSGGKQALETVQRLLPVLRQAHGLTPDQVVAIASNSGGKPALETVQRLLPVLCEQHGLTPDQVVAIASNNGGKQALETVQRLLPVLCEQHGLTRAQVVAIASNGGGKQALETVQRLLPVLCEQHGLTPDQVVAIASHDGGKQALETVQRLLPVLRQAHGLTPAQVVAIASNNGGKPALETVQRLLPVLCEQHGLTPDQVVAIASNIGGKQALETVQRLLPVLCEQHGLTPDQVVAIASNGGGKPALESTFAQLSRPDQALAALTNDHLVALACLGGRPALEAVRKGLPHAPTLIKRTNRRLPERTSHRVADHAQVARVLGFFQCHSHPAQAFDEAMTQFGMSRHGLLQLFRRAGVTELEARSGTLPPASQRWHRILQASGMKRAEPSGASAQTPDQASLHAFADALERELDAPSPIDRAGQALASSSRKRSRSESSVTGSFAQQAVEVRVPEQRDALHFLPLSWGVKRPRTRIGGGLPDPGTPMDADLAPSSTVMWEQDADPFAGAADDFPAFNEEEMAWLMELFPQ

SEQ ID NO: 168 - DNA, 102 bp, Artificial Sequence
  Description of Artificial Sequence: Synthetic polynucleotide
ttgaccccagagcaggtcgtggcgatcgcaagccacgacggaggaaagcaagccttggaaacagtacagaggctgttgcctgtgctgtgccaagcgcacggg

SEQ ID NO: 169 - DNA, 102 bp, Artificial Sequence
  Description of Artificial Sequence: Synthetic polynucleotide
ctgaccccagagcaggtcgtggcaatcgcctccaacattggcgggaaacaggcactcgagactgtccagcgcctgcttcccgtgctgtgccaagcgcacgga

SEQ ID NO: 170 - DNA, 102 bp, Artificial Sequence
  Description of Artificial Sequence: Synthetic polynucleotide
ctgaccccagagcaggtcgtggccattgcctcgaatggagggggcaaacaggcgttggaaaccgtacaacgattgctgccggtgctgtgccaagcgcacggc

SEQ ID NO: 171 - DNA, 102 bp, Artificial Sequence
  Description of Artificial Sequence: Synthetic polynucleotide
cttaccccagagcaggtcgtggcaatcgcgagcaataacggcggaaaacaggctttggaaacggtgcagaggctccttccagtgctgtgccaagcgcacggg

SEQ ID NO: 172 - protein, 34 aa, Xanthomonas sp.
LTPDQVVAIASNSGGKQALETVQRLLPVLCQDHG

SEQ ID NO: 173 - protein, 34 aa, Xanthomonas sp.
LTPDQVVAIANNKGGKQALETLQRLLPVLCQDHG

SEQ ID NO: 174 - protein, 34 aa, Xanthomonas sp.
LTPDQVVAIASHGGGKQALETVQRLLPVLCQDHG

SEQ ID NO: 175 - protein, 34 aa, Xanthomonas sp.
LTPAQVVAIASHHGGKQALETVQRLLPVLCQDHG

SEQ ID NO: 176 - protein, 34 aa, Xanthomonas sp.
LTPYQVVAIASNDGSKQALETVQRLLPVLCQDHG

SEQ ID NO: 177 - protein, 34 aa, Xanthomonas sp.
LTPDQVVAIANSNGGKQALETVQRLLPVLCQDHG

SEQ ID NO: 178 - protein, 34 aa, Xanthomonas sp.
LTPDQVVAIASYGGGKQALETVQRVLPVLCQDHG

SEQ ID NO: 179 - protein, 34 aa, Xanthomonas sp.
LTPDQVVAIASHNGGKQALETVQRLLPVLCQDHG

SEQ ID NO: 180 - protein, 34 aa, Xanthomonas sp.
LTPDQVVAIASHAGGKQALETVQRLLPVLCQDHG

SEQ ID NO: 181 - protein, 34 aa, Xanthomonas sp.
LTPDQVVAIASSSGGKQALETVQRLLPVLCQDHG

SEQ ID NO: 182 - protein, 34 aa, Xanthomonas sp.
LTLDQVVAIASNAGGKQALETVQRLLPVLCQDHG

SEQ ID NO: 183 - protein, 34 aa, Xanthomonas sp.
LTPDQVVAIANNVGGKQALATVQRLLPVLCQDHG

SEQ ID NO: 184 - protein, 34 aa, Xanthomonas sp.
LTPAQVVAIASHIGGKQALETVQRLLPVLCQDHG

SEQ ID NO: 185 - protein, 34 aa, Xanthomonas sp.
LTPDQVVAIASNQGGKQALATVQRLLPVLCQDHG

SEQ ID NO: 186 - protein, 34 aa, Xanthomonas sp.
LTPDQVVAIANNHGGKQALETVQRLLPVLCQDHG

SEQ ID NO: 187 - protein, 34 aa, Xanthomonas sp.
LTPDQVVAIASNCGGKQALETVQRLLPVLCQDHG

SEQ ID NO: 188 - protein, 34 aa, Xanthomonas sp.
LTREQVVAIASIGGGKQALETVQRLLPVLCQDHG

SEQ ID NO: 189 - protein, 33 aa, Xanthomonas sp.
LTPDQVVAIASNGGKQALETVQRLLPVLCQDHG

SEQ ID NO: 190 - protein, 33 aa, Xanthomonas sp.
LTPAQVVAIASSGGKQALETVQRLLPVLCQDHG

SEQ ID NO: 191 - protein, 33 aa, Xanthomonas sp.
LTPDQVVAIASHGGKQALETVQRLLPVLCQDHG

SEQ ID NO: 192 - DNA, 2349 bp, Artificial Sequence
  Description of Artificial Sequence: Synthetic polynucleotide
atgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccgagacggtacatgaaacgcatggcacggcgtctcaactcacgcctgagcaggtagtggctattgcatccaatatcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 193 - DNA, 2349 bp, Artificial Sequence
  Description of Artificial Sequence: Synthetic polynucleotide
atgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccgagacggtacatgaaacgcatggcacggcgtctcaactcacgcctgagcaggtagtggctattgcatccaatggcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 194 - DNA, 2349 bp, Artificial Sequence
  Description of Artificial Sequence: Synthetic polynucleotide
atgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccgagacggtacatgaaacgcatggcacggcgtctcaactcacgcctgagcaggtagtggctattgcatcccatgacgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 195 - DNA, 2349 bp, Artificial Sequence
  Description of Artificial Sequence: Synthetic polynucleotide
atgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccgagacggtacatgaaacgcatggcacggcgtctcaactcacgcctgagcaggtagtggctattgcatccaataacgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaggcagtggagagggcagaggaagtctgctaacatgcggtgacgtcgaggagaatcctggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 196 - protein, 34 aa, Artificial Sequence
  Description of Artificial Sequence: Synthetic polypeptide
LTPEQVVAIASNIGGKQALETVQRLLPVLCQAHG

SEQ ID NO: 197 - DNA, 102 bp, Artificial Sequence; identical to SEQ ID NO: 169
  Description of Artificial Sequence: Synthetic polynucleotide
  CDS (1)..(102)

SEQ ID NO: 198 - protein, 34 aa, Artificial Sequence
  Description of Artificial Sequence: Synthetic polypeptide
LTPEQVVAIASHDGGKQALETVQRLLPVLCQAHG

SEQ ID NO: 199 - DNA, 102 bp, Artificial Sequence; identical to SEQ ID NO: 168
  Description of Artificial Sequence: Synthetic polynucleotide
  CDS (1)..(102)

SEQ ID NO: 200 - protein, 34 aa, Artificial Sequence
  Description of Artificial Sequence: Synthetic polypeptide
LTPEQVVAIASNNGGKQALETVQRLLPVLCQAHG

SEQ ID NO: 201 - DNA, 102 bp, Artificial Sequence; identical to SEQ ID NO: 171
  Description of Artificial Sequence: Synthetic polynucleotide
  CDS (1)..(102)

SEQ ID NO: 202 - protein, 34 aa, Artificial Sequence; identical to SEQ ID NO: 1
  Description of Artificial Sequence: Synthetic polypeptide

SEQ ID NO: 203 - DNA, 102 bp, Artificial Sequence; identical to SEQ ID NO: 170
  Description of Artificial Sequence: Synthetic polynucleotide
  CDS (1)..(102)

SEQ ID NO: 204 - DNA, 44 bp, Artificial Sequence
  Description of Artificial Sequence: Synthetic primer
agatgccgtcctagcgcgtctcctgaccccagagcaggtcgtgg

SEQ ID NO: 205 - DNA, 45 bp, Artificial Sequence
  Description of Artificial Sequence: Synthetic primer
agatgccgtcctagcgcgtctcgactcaccccagagcaggtcgtg

SEQ ID NO: 206 - DNA, 45 bp, Artificial Sequence
  Description of Artificial Sequence: Synthetic primer
agatgccgtcctagcgcgtctcgcctcaccccagagcaggtcgtg

SEQ ID NO: 207 - DNA, 45 bp, Artificial Sequence
  Description of Artificial Sequence: Synthetic primer
agatgccgtcctagcgcgtctcgattaaccccagagcaggtcgtg

SEQ ID NO: 208 - DNA, 45 bp, Artificial Sequence
  Description of Artificial Sequence: Synthetic primer
agatgccgtcctagcgcgtctcgcttaaccccagagcaggtcgtg

SEQ ID NO: 209 - DNA, 45 bp, Artificial Sequence
  Description of Artificial Sequence: Synthetic primer
agatgccgtcctagcgcgtctcgacttaccccagagcaggtcgtg

SEQ ID NO: 210 - DNA, 45 bp, Artificial Sequence
  Description of Artificial Sequence: Synthetic primer
agatgccgtcctagcgcgtctcgccttaccccagagcaggtcgtg

SEQ ID NO: 211 - DNA, 45 bp, Artificial Sequence
  Description of Artificial Sequence: Synthetic primer
agatgccgtcctagcgcgtctcgactaaccccagagcaggtcgtg

SEQ ID NO: 212 - DNA, 45 bp, Artificial Sequence
  Description of Artificial Sequence: Synthetic primer
agatgccgtcctagcgcgtctcggctcaccccagagcaggtcgtg

SEQ ID NO: 213 - DNA, 45 bp, Artificial Sequence
  Description of Artificial Sequence: Synthetic primer
agatgccgtcctagcgcgtctcggctaaccccagagcaggtcgtg

SEQ ID NO: 214 - DNA, 45 bp, Artificial Sequence
  Description of Artificial Sequence: Synthetic primer
agatgccgtcctagcgcgtctcgcctaaccccagagcaggtcgtg

SEQ ID NO: 215 - DNA, 45 bp, Artificial Sequence
  Description of Artificial Sequence: Synthetic primer
agatgccgtcctagcgcgtctcggttaaccccagagcaggtcgtg

SEQ ID NO: 216 - DNA, 44 bp, Artificial Sequence
  Description of Artificial Sequence: Synthetic primer
gtatctttcctgtgcccaggtctctgagtccgtgcgcttggcac

SEQ ID NO: 217 - DNA, 44 bp, Artificial Sequence
  Description of Artificial Sequence: Synthetic primer
gtatctttcctgtgcccaggtctctgaggccgtgcgcttggcac

SEQ ID NO: 218 - DNA, 44 bp, Artificial Sequence
  Description of Artificial Sequence: Synthetic primer
gtatctttcctgtgcccaggtctcttaatccgtgcgcttggcac

SEQ ID NO: 219 - DNA, 44 bp, Artificial Sequence
  Description of Artificial Sequence: Synthetic primer
gtatctttcctgtgcccaggtctcttaagccgtgcgcttggcac

SEQ ID NO: 220 - DNA, 44 bp, Artificial Sequence
  Description of Artificial Sequence: Synthetic primer
gtatctttcctgtgcccaggtctctaagtccgtgcgcttggcac

SEQ ID NO: 221 - DNA, 44 bp, Artificial Sequence
  Description of Artificial Sequence: Synthetic primer
gtatctttcctgtgcccaggtctctaaggccgtgcgcttggcac

SEQ ID NO: 222 - DNA, 44 bp, Artificial Sequence
  Description of Artificial Sequence: Synthetic primer
gtatctttcctgtgcccaggtctcttagtccgtgcgcttggcac

SEQ ID NO: 223 - DNA, 44 bp, Artificial Sequence
  Description of Artificial Sequence: Synthetic primer
gtatctttcctgtgcccaggtctctgagcccgtgcgcttggcac

SEQ ID NO: 224 - DNA, 44 bp, Artificial Sequence
  Description of Artificial Sequence: Synthetic primer
gtatctttcctgtgcccaggtctcttagcccgtgcgcttggcac

SEQ ID NO: 225 - DNA, 44 bp, Artificial Sequence
  Description of Artificial Sequence: Synthetic primer
gtatctttcctgtgcccaggtctcttaggccgtgcgcttggcac

SEQ ID NO: 226 - DNA, 44 bp, Artificial Sequence
  Description of Artificial Sequence: Synthetic primer
gtatctttcctgtgcccaggtctcttaacccgtgcgcttggcac

SEQ ID NO: 227 - DNA, 44 bp, Artificial Sequence
  Description of Artificial Sequence: Synthetic primer
gtatctttcctgtgcccaggtctcttaaaccgtgcgcttggcac

SEQ ID NO: 228 - DNA, 21 bp, Artificial Sequence
  Description of Artificial Sequence: Synthetic primer
atatagatgccgtcctagcgc

SEQ ID NO: 229 - DNA, 21 bp, Artificial Sequence
  Description of Artificial Sequence: Synthetic primer
aagtatctttcctgtgcccag

SEQ ID NO: 230 - DNA, 48 bp, Artificial Sequence
  Description of Artificial Sequence: Synthetic primer
atatagatgccgtcctagcgcgtctcctgaccccagagcaggtcgtgg

SEQ ID NO: 231 - DNA, 49 bp, Artificial Sequence
  Description of Artificial Sequence: Synthetic primer
tgctctttattcgttgcgtcggtctcgactcaccccagagcaggtcgtg

SEQ ID NO: 232 - DNA, 49 bp, Artificial Sequence
  Description of Artificial Sequence: Synthetic primer
tgctctttattcgttgcgtcggtctcgcctcaccccagagcaggtcgtg

SEQ ID NO: 233 - DNA, 49 bp, Artificial Sequence
  Description of Artificial Sequence: Synthetic primer
tgctctttattcgttgcgtcggtctcgattaaccccagagcaggtcgtg

SEQ ID NO: 234 - DNA, 49 bp, Artificial Sequence
  Description of Artificial Sequence: Synthetic primer
atatagatgccgtcctagcgcgtctcgcttaaccccagagcaggtcgtg

SEQ ID NO: 235 - DNA, 49 bp, Artificial Sequence; identical to SEQ ID NO: 231
  Description of Artificial Sequence: Synthetic primer

SEQ ID NO: 236 - DNA, 49 bp, Artificial Sequence; identical to SEQ ID NO: 232
  Description of Artificial Sequence: Synthetic primer

SEQ ID NO: 237 - DNA, 49 bp, Artificial Sequence; identical to SEQ ID NO: 233
  Description of Artificial Sequence: Synthetic primer

SEQ ID NO: 238 - DNA, 49 bp, Artificial Sequence
  Description of Artificial Sequence: Synthetic primer
atatagatgccgtcctagcgcgtctcggctcaccccagagcaggtcgtg

SEQ ID NO: 239 - DNA, 49 bp, Artificial Sequence; identical to SEQ ID NO: 231
  Description of Artificial Sequence: Synthetic primer

SEQ ID NO: 240 - DNA, 49 bp, Artificial Sequence; identical to SEQ ID NO: 232
  Description of Artificial Sequence: Synthetic primer

SEQ ID NO: 241 - DNA, 49 bp, Artificial Sequence; identical to SEQ ID NO: 233
  Description of Artificial Sequence: Synthetic primer

SEQ ID NO: 242 - DNA, 46 bp, Artificial Sequence
  Description of Artificial Sequence: Synthetic primer
tcttatcggtgcttcgttctggtctctgagtccgtgcgcttggcac

SEQ ID NO: 243 - DNA, 46 bp, Artificial Sequence
  Description of Artificial Sequence: Synthetic primer
tcttatcggtgcttcgttctggtctctgaggccgtgcgcttggcac

SEQ ID NO: 244 - DNA, 46 bp, Artificial Sequence
  Description of Artificial Sequence: Synthetic primer
tcttatcggtgcttcgttctggtctcttaatccgtgcgcttggcac

SEQ ID NO: 245 - DNA, 46 bp, Artificial Sequence
  Description of Artificial Sequence: Synthetic primer
aagtatctttcctgtgcccacgtctcttaagccgtgcgcttggcac

SEQ ID NO: 246 - DNA, 46 bp, Artificial Sequence; identical to SEQ ID NO: 242
  Description of Artificial Sequence: Synthetic primer

SEQ ID NO: 247 - DNA, 46 bp, Artificial Sequence; identical to SEQ ID NO: 243
  Description of Artificial Sequence: Synthetic primer

SEQ ID NO: 248 - DNA, 46 bp, Artificial Sequence; identical to SEQ ID NO: 244
  Description of Artificial Sequence: Synthetic primer

SEQ ID NO: 249 - DNA, 46 bp, Artificial Sequence
  Description of Artificial Sequence: Synthetic primer
aagtatctttcctgtgcccacgtctctgagcccgtgcgcttggcac

SEQ ID NO: 250 - DNA, 46 bp, Artificial Sequence; identical to SEQ ID NO: 242
  Description of Artificial Sequence: Synthetic primer

SEQ ID NO: 251 - DNA, 46 bp, Artificial Sequence; identical to SEQ ID NO: 243
  Description of Artificial Sequence: Synthetic primer

SEQ ID NO: 252 - DNA, 46 bp, Artificial Sequence; identical to SEQ ID NO: 244
  Description of Artificial Sequence: Synthetic primer

SEQ ID NO: 253 - DNA, 46 bp, Artificial Sequence
  Description of Artificial Sequence: Synthetic primer
aagtatctttcctgtgcccacgtctctgagtccgtgcgcttggcac

SEQ ID NO: 254 - DNA, 20 bp, Artificial Sequence
  Description of Artificial Sequence: Synthetic primer
atatagatgccgtcctagcg

SEQ ID NO: 255 - DNA, 20 bp, Artificial Sequence
  Description of Artificial Sequence: Synthetic primer
aagtatctttcctgtgccca

SEQ ID NO: 256 - protein, 34 aa, Xanthomonas campestris; identical to SEQ ID NO: 1

SEQ ID NO: 257 - DNA, 14 bp, Artificial Sequence
  Description of Artificial Sequence: Synthetic oligonucleotide
tacgactcactata

SEQ ID NO: 258 - DNA, 29 bp, Artificial Sequence
  Description of Artificial Sequence: Synthetic oligonucleotide
  CDS (9)..(29)
cgtctcgactcaccccagagcaggtcgtg

SEQ ID NO: 259 - protein, 7 aa, Artificial Sequence
  Description of Artificial Sequence: Synthetic peptide
LTPEQVV

SEQ ID NO: 260 - DNA, 25 bp, Artificial Sequence
  Description of Artificial Sequence: Synthetic oligonucleotide
  CDS (1)..(18)
tgccaagcgcacggcctcagagacc

SEQ ID NO: 261 - protein, 6 aa, Artificial Sequence
  Description of Artificial Sequence: Synthetic peptide
CQAHGL

SEQ ID NO: 262 - DNA, 22 bp, Artificial Sequence
  Description of Artificial Sequence: Synthetic oligonucleotide
actcaccccagagcaggtcgtg

SEQ ID NO: 263 - DNA, 14 bp, Artificial Sequence
  Description of Artificial Sequence: Synthetic oligonucleotide
tgccaagcgcacgg

SEQ ID NO: 264 - DNA, 18 bp, Artificial Sequence
  Description of Artificial Sequence: Synthetic oligonucleotide
cacgacctgctctggggt

SEQ ID NO: 265 - DNA, 18 bp, Artificial Sequence
  Description of Artificial Sequence: Synthetic oligonucleotide
gaggccgtgcgcttggca

SEQ ID NO: 266 - DNA, 102 bp, Artificial Sequence
  Description of Artificial Sequence: Synthetic polynucleotide
ggatccacgtatgtcgaggtaggcgtgtacggtgggaggcctatataagcagagctcgtttagtgaaccgtcagatcgcctggaggtaccgccaccatggtg

SEQ ID NO: 267 - DNA, 14 bp, Artificial Sequence
  Description of Artificial Sequence: Synthetic oligonucleotide
tccgcctccctctc

SEQ ID NO: 268 - DNA, 14 bp, Artificial Sequence
  Description of Artificial Sequence: Synthetic oligonucleotide
tgcggctcgctgtg

SEQ ID NO: 269 - DNA, 14 bp, Artificial Sequence
  Description of Artificial Sequence: Synthetic oligonucleotide
taagaataaatata

SEQ ID NO: 270 - DNA, 14 bp, Artificial Sequence
  Description of Artificial Sequence: Synthetic oligonucleotide
tatgatttattata

SEQ ID NO: 271 - DNA, 14 bp, Artificial Sequence
  Description of Artificial Sequence: Synthetic oligonucleotide
taggagtgagtata

SEQ ID NO: 272 - DNA, 14 bp, Artificial Sequence
  Description of Artificial Sequence: Synthetic oligonucleotide
tacaactcactata

SEQ ID NO: 273 - DNA, 14 bp, Artificial Sequence
  Description of Artificial Sequence: Synthetic oligonucleotide
taccactcactata

SEQ ID NO: 274 - DNA, 14 bp, Artificial Sequence
  Description of Artificial Sequence: Synthetic oligonucleotide
tacgacgcacaaaa

SEQ ID NO: 275 - DNA, 14 bp, Artificial Sequence
  Description of Artificial Sequence: Synthetic oligonucleotide
tcacgattcttccc

SEQ ID NO: 276 - DNA, 14 bp, Artificial Sequence
  Description of Artificial Sequence: Synthetic oligonucleotide
tctcttccctcctt

SEQ ID NO: 277 - DNA, 14 bp, Artificial Sequence
  Description of Artificial Sequence: Synthetic oligonucleotide
tccttccaccggca

SEQ ID NO: 278 - DNA, 14 bp, Artificial Sequence
  Description of Artificial Sequence: Synthetic oligonucleotide
ttttgttttcttta

SEQ ID NO: 279 - DNA, 18 bp, Artificial Sequence
  Description of Artificial Sequence: Synthetic oligonucleotide
ggggccggagccgcagtg

SEQ ID NO: 280 - DNA, 14 bp, Artificial Sequence
  Description of Artificial Sequence: Synthetic oligonucleotide
tattgttttcttta

SEQ ID NO: 281 - DNA, 14 bp, Artificial Sequence
  Description of Artificial Sequence: Synthetic oligonucleotide
ttttgttttcttaa

SEQ ID NO: 282 - DNA, 14 bp, Artificial Sequence
  Description of Artificial Sequence: Synthetic oligonucleotide
taatgttttcttta

SEQ ID NO: 283 - DNA, 14 bp, Artificial Sequence
  Description of Artificial Sequence: Synthetic oligonucleotide
ttttgtaatcttta

SEQ ID NO: 284 - DNA, 14 bp, Artificial Sequence
  Description of Artificial Sequence: Synthetic oligonucleotide
ttttgttttctaaa

SEQ ID NO: 285 - DNA, 14 bp, Artificial Sequence
  Description of Artificial Sequence: Synthetic oligonucleotide
tcttgttttcttta

SEQ ID NO: 286 - DNA, 14 bp, Artificial Sequence
  Description of Artificial Sequence: Synthetic oligonucleotide
ttttgttttcttca

SEQ ID NO: 287 - DNA, 14 bp, Artificial Sequence
  Description of Artificial Sequence: Synthetic oligonucleotide
tcctgttttcttta

SEQ ID NO: 288 - DNA, 14 bp, Artificial Sequence
  Description of Artificial Sequence: Synthetic oligonucleotide
ttttgtcctcttta

SEQ ID NO: 289 - DNA, 14 bp, Artificial Sequence
  Description of Artificial Sequence: Synthetic oligonucleotide
ttttgttttctcca

SEQ ID NO: 290 - DNA, 14 bp, Artificial Sequence
  Description of Artificial Sequence: Synthetic oligonucleotide
tgttgttttcttta

SEQ ID NO: 291 - DNA, 14 bp, Artificial Sequence
  Description of Artificial Sequence: Synthetic oligonucleotide
ttttgttttcttga

SEQ ID NO: 292 - DNA, 14 bp, Artificial Sequence
  Description of Artificial Sequence: Synthetic oligonucleotide
tggtgttttcttta

SEQ ID NO: 293 - DNA, 14 bp, Artificial Sequence
  Description of Artificial Sequence: Synthetic oligonucleotide
ttttgtggtcttta

SEQ ID NO: 294 - DNA, 14 bp, Artificial Sequence
  Description of Artificial Sequence: Synthetic oligonucleotide
ttttgttttctgga

SEQ ID NO: 295 - DNA, 14 bp, Artificial Sequence
  Description of Artificial Sequence: Synthetic oligonucleotide
ttcgtctctctttt

SEQ ID NO: 296 - DNA, 14 bp, Artificial Sequence
  Description of Artificial Sequence: Synthetic oligonucleotide
tactactcactata

SEQ ID NO: 297 - DNA, 14 bp, Artificial Sequence
  Description of Artificial Sequence: Synthetic oligonucleotide
aacgacacacaaaa

SEQ ID NO: 298 - DNA, 14 bp, Artificial Sequence
  Description of Artificial Sequence: Synthetic oligonucleotide
gacgacgcacgaga

SEQ ID NO: 299 - DNA, 14 bp, Artificial Sequence
  Description of Artificial Sequence: Synthetic oligonucleotide
cacgacccaccaca

SEQ ID NO: 300 - DNA, 14 bp, Artificial Sequence
  Description of Artificial Sequence: Synthetic oligonucleotide
tgcgactcactata

SEQ ID NO: 301 - DNA, 14 bp, Artificial Sequence
  Description of Artificial Sequence: Synthetic oligonucleotide
tccgactcactata

SEQ ID NO: 302 - DNA, 14 bp, Artificial Sequence
  Description of Artificial Sequence: Synthetic oligonucleotide
ttcgactcactata

SEQ ID NO: 303 - DNA, 14 bp, Artificial Sequence
  Description of Artificial Sequence: Synthetic oligonucleotide
tacgacacactata

SEQ ID NO: 304 - DNA, 14 bp, Artificial Sequence
  Description of Artificial Sequence: Synthetic oligonucleotide
tacgacgcactata

SEQ ID NO: 305 - DNA, 14 bp, Artificial Sequence
  Description of Artificial Sequence: Synthetic oligonucleotide
tacgacccactata

SEQ ID NO: 306 - DNA, 14 bp, Artificial Sequence
  Description of Artificial Sequence: Synthetic oligonucleotide
tacgactaactata

SEQ ID NO: 307 - DNA, 14 bp, Artificial Sequence
  Description of Artificial Sequence: Synthetic oligonucleotide
tacgacttactata

SEQ ID NO: 308 - DNA, 14 bp, Artificial Sequence
  Description of Artificial Sequence: Synthetic oligonucleotide
tacgactgactata

SEQ ID NO: 309 - protein, 288 aa, Xanthomonas campestris
MDPIRSRTPSPARELLSGPQPDGVQPTADRGVSPPAGGPLDGLPARRTMSRTRLPSPPAPSPAFSADSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 310 - protein, 283 aa, Xanthomonas campestris
RPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLLSWGVKRPRTRIGGLLDPGTPMDADLVASSTVVWEQDADPFAGTADDFPAFNEEELAWLMELLPQ

SEQ ID NO: 311 - DNA, 14 bp, Artificial Sequence
  Description of Artificial Sequence: Synthetic oligonucleotide
tttattccctgaca

SEQ ID NO: 312 - DNA, 14 bp, Artificial Sequence
  Description of Artificial Sequence: Synthetic oligonucleotide
ttcttacttataac

SEQ ID NO: 313 - DNA, 14 bp, Artificial Sequence
  Description of Artificial Sequence: Synthetic oligonucleotide
tcccgagtccccaa

SEQ ID NO: 314 - DNA, 14 bp, Artificial Sequence
  Description of Artificial Sequence: Synthetic oligonucleotide
ttctcccaccccca

SEQ ID NO: 315 - protein, 6 aa, Artificial Sequence
  Description of Artificial Sequence: Synthetic 6xHis tag
HHHHHH

We claim:

1. A nucleic acid molecule encoding a designer transcription activator-like effector (dTALE) polypeptide fragment, the nucleic acid molecule comprising a sequence encoding a nucleic acid binding domain of the dTALE polypeptide fragment and one or more mammalian effector domains, wherein the sequence encoding the nucleic acid binding domain comprises a sequence encoding two or more monomer units arranged in a predetermined 5' to 3' non-endogenous TALE order, wherein each said monomer unit comprises a variable diresidue that is capable of specifically binding a target nucleotide, wherein the nucleic acid binding domain encoded by the nucleic acid molecule is capable of specifically binding a predetermined target nucleic acid sequence, wherein each of the one or more mammalian effector domains encoded by the nucleic acid molecule is capable of mediating an effector function, and wherein the nucleic acid molecule further comprises an expression vector comprising the sequence of an expression vector of SEQ ID NOs: 192-195.

2. The nucleic acid molecule of claim 1, wherein the two or more monomer units of the sequence comprise:

a) the monomer units of a TALE polypeptide of SEQ ID NOs: 4-167; the monomer units encoded by the nucleic acid sequences of SEQ ID NOs: 168-171; or the monomer units of SEQ ID NOs: 172-191; or b) an amino acid sequence that is at least 70% identical to: the monomer units of a TALE polypeptide of SEQ ID NOs: 4-167; the monomer units encoded by the nucleic acid sequences of SEQ ID NOs: 168-171; or the monomer units of SEQ ID NOs: 172-191.

3. The nucleic acid molecule of claim 1, wherein the predetermined target nucleic acid sequence to which the nucleic acid binding domain specifically binds comprises a bacterial, protozoan, fungal, animal, or viral nucleic acid sequence.

4. The nucleic acid molecule of claim 1, wherein the nucleic acid molecule further comprises at least one nucleic acid sequence:

a) of an expression vector;

b) of a nuclear localization signal;

c) encoding an N-terminal domain that is at least 70% identical to an amino acid sequence of an N-terminal domain from a transcription activator-like effector (TALE) polypeptide from a bacterium of the genus *Xanthomonas*, or a fragment thereof, and wherein the at least one nucleic acid sequence encoding the N-terminal domain is 5' of the sequence encoding the nucleic acid binding domain of the dTALE polypeptide;

d) encoding a C-terminal domain that is at least 70% identical to an amino acid sequence of a C-terminal domain from a transcription activator-like effector (TALE) polypeptide from a bacterium of the genus *Xanthomonas*, or a fragment thereof, and wherein the at least one nucleic acid sequence encoding the C-terminal domain is 3' of the sequence encoding the nucleic acid binding domain of the dTALE polypeptide; or e) any combination thereof.

5. The nucleic acid molecule of claim 4, wherein the nucleic acid molecule comprises: a sequence encoding an N-terminal domain that is at least 70% identical to the amino acid sequence of an N-terminal domain sequence from a transcription activator-like effector (TALE) polypeptide from a bacterium of the genus *Xanthomonas*, or a fragment thereof, and wherein the sequence encoding the N-terminal domain is 5' of the sequence encoding the nucleic acid binding domain of the dTALE polypeptide; a sequence encoding a C-terminal domain that is at least 70% identical to the amino acid sequence of a C-terminal domain from a transcription activator-like effector (TALE) polypeptide from a bacterium of the genus *Xanthomonas*, or a fragment thereof, and wherein the sequence encoding the C-terminal domain is 3' of the sequence encoding the nucleic acid binding domain of the dTALE polypeptide; or a combination thereof, and the TALE polypeptide from a bacterium of the genus *Xanthomonas* comprises a sequence of SEQ ID NOs: 4-167.

6. The nucleic acid molecule of claim 1, wherein the variable diresidue of at least one of the monomer units is an engineered variable diresidue capable of specifically binding a predetermined target nucleotide.

7. The nucleic acid molecule of claim 1, wherein the sequence encoding two or more monomer units is an engineered sequence capable of minimizing sequence repetitiveness among the monomer units encoded by the nucleic acid molecule.

8. The nucleic acid molecule of claim 1, wherein a monomer unit encoded at the 5' end of the nucleic acid molecule specifically binds to a thymine nucleotide.

9. The nucleic acid molecule of claim 6, wherein the variable diresidue of at least one of the monomer units encoded by the nucleic acid molecule is an engineered variable diresidue capable of specifically binding the predetermined target nucleotide by encoding NG for specifically binding thymine, HD for specifically binding cytosine, NI for specifically binding adenine, or NN for specifically binding guanine.

10. The nucleic acid molecule of claim 1, wherein the sequence encoding the two or more monomer units is contiguous and does not comprise insertion or deletion of nucleic acid sequences.

11. The nucleic acid molecule of claim 4, wherein the expression vector, the one or more mammalian effector domains, the nuclear localization signal, or a combination thereof has activity in a host cell that is not a plant cell.

12. The nucleic acid molecule of claim 1, wherein the effector function comprises a nuclease function, recombinase function, epigenetic modifying function, transposase function, integrase function, resolvase function, invertase function, protease function, DNA methyltransferase function, DNA demethylase function, histone acetylase function, histone deacetylase function, transcriptional repressor function, transcriptional activator function, DNA binding protein function, transcription factor recruiting protein function, nuclearlocalization signal function, cellular uptake signal activity function, or any combination thereof.

* * * * *